United States Patent 12,509,677 (PROBIOTIC STRAINS HAVING INCREASED STORAGE STABILITY) - sequence listing, part 3

SEQ ID NO: 3 - DNA, 1234802 bp, Lactobacillus paracasei
atgcccaatttagaggaactttgggcttacctgaatgataaattccgtgaagaattgaccccggtcggttacagcacatggatccagacagcaaaacccgtcaaattaaccaaagataaactcgaaattgaagtcccagcttctttacacaaagcttattgggaaaagaatctcgtgaccaaggtagtcgaaggcgtttacgaattcgcgcaacttgaagttgatcccgtcattatgaccaaggatgagttgcagccagctccggctacagatcaacgtcctgcggttgaagaagacgatcaaaatctgacttttaaggcaaaaacccatttaaatccgaaatatacgtttgaccgcttcgtgattggtaagggaaaccaaatggcccacgcggctgctttggcggttgctgaagcccctgggacaacatacaaccctctgtttatttatggtggcgtcggtcttggcaaaacccacttaatgcaagcgattggtaatttggtgctaggtaataatccagcagccaacataaaatacgtcaccagtgagaattttgctaatgatttcattaactcgattcaaaccaaacaacaggaacaatttcggcaagaataccgaaatgtggacctgctgttggtagatgatattcagttttttggtgacaaagaggccacacaggaagaattttttcataccttcaatacgctgtatgaaaatatgaagcaaattgttctgaccagtgatcgcctgcctaacgaaatccccaaacttcaagaacggttggtttcgcggtttaataagggcttgtctgtcgatgtcacaccgccagatctggaaacacgaatcgctattttgcgcaataaagccgatgctgaagatctcagcattccagatgacaccttgtcttacattgctggtcaaattgaaagtaacgtacgtgatctcgaaggtgcgttagtacgcgttcaggccttttcaaccatgaaaaacgaagatatcagaccagcttagccgcggatgccttgaaagccctgaaacttgatgaccgcagcggacaattgaccattccgcaaatcctgaatgctgtcgcgaaatattttcagctgacggttcaggatcttaaaggaaagaaacgcgtcaaacagattgtcattccgcgccaaatcgcgatgtatctagcgcgcgaaatgaccgataacagtttaccgaaaataggtcaggaaatcggcggcaaggatcatacaaccgtcatccatgcccacgaaaaaattatggcttcaatgacaactgatgagaatttaaaagctcaagtgatcgaattgcggaatatcttgaaaaaccgcgggtaatgcacatgtggataaccttcaaaaacaaaccattttatccgtcgcacttatccacaagtgcataactttctcagttgttgtttctcaaagttttccacagtttgaacacgccctattactattacttcaaaagctttatattatatatataaaagacgttcaggaggctcttatgaaatttacgatcacccgatccacattcttaaaaaccttgaatgatgtttctcgggccatttcaaccaaaacaaccattccgattctgactggattgaaaattgtgctcaacgatagcggcttaatcctcactggtagtgatgccgatatttcaatcgaatcacggatcaacgcaacggatgaaaataatgatctccaaatcggaagcactggtgaaatcgtcttgccagcccgtttctttagcgaaatcgttaaacgtttgccagaaagcacaatgacgcttgaagttaaagacaatttccaaaccgtcatcacgtctggggcatctgaatttactattaatggtttggatgccaataactatccgcggttgccagaaattacagccgatgcagcgttgagtgtttcagctgatgtgttacgtcagttgattaaccaaacagttattgccgtttctaatcaggaaagtcgaccaacttgacaggggttcatctgacaattaccggcgatcagttggtagctgttgcgactgattcccaccgccttgcgcaacgtagcctgaccttaccaacagcaagtgcctcggattatgacatcattattccagggaaaagtctgacagaacttagccgcatgttaagcgatgacgttgaaaaaatcgaaattcgcattgcggaaaatcaagtgctgttcgtgtttgggcaaacggccttttattcacgcttacttgaaggcaactaccctgacacaagccgacttattccaacatccagcaatacgcaagcggaatttgacgcaccagcattgctggcctccattcaacgtgccagcttgctgagtcacgaaagtagcaacaatgtggttcggcttgtccttaatatcgctgatcaaaaagcgactatctacggtaattcgccagatgtcggtaatgttgaagaagtacttagtttcaacaaacttagcggcgaggatctaaaatctcgttcaaccctgactatatgaaggatgctttgcaaggatttggccaaacggcaattgaagttgacttcaccgcaccattgcgaccattcactttggttccaacagaagacaaggaacggtttatccaactcatcacgccagttcgaacgttttaacacgtgatgtagcaacaaagagcgccaattaaaaaagattctagagagtgatgaattctctagaatcttttttgttatcgaactgatattcgccaaagcttagtgttttcttttgacgaaataataatagacaaatgccaagacacaacccatcaagacgctgaccaagattgtcataggattcagccaattatgaaaatctgtattgaaatttccatagacgtacgtagccactgaagaaattaaaaagataccaaagaccgacttagtagtagatgtcatattttcctccatatatgggtgcagactgcgctttcacaaatagaaaataaatacataatagtagatagtcaatatattatttttataaaataataagagcctatacaaagctttatgttaacttttatgaaattaaaaagtgacttttaatgtaaaaagacacatttatacattgttctatgctctaattatacagaagtgattatagatagccaagtgtgcagcctttcatttttgaaggctaatcgcgattcacgatcaaattgcaaaaacgttcatttgcgttgcttgatatttttaaacgcagatttggatattgctggacaaaagtaaaagtagctttagagttggtcaaaatcgatagaaatcaaaatttagccgattttggcctttctgggtctttttagtctagggggacgcacaacgttcagattgcctcagagccgctttaatgccgttttagaattgtgttttaagtagtataagggtataattaatttgtgttcattgacgacaaatcgcggtttaacgcggtttgtctagcacttttcggaatgagggcgacagcaatgacaacaatcgaaatcacgaccccttttttgaccttgggccagtttctgaaagaggcgggattgatcgatagtggcggtgcggccaagtggtatctgggcgaaaactcagtgacagtcaacggcgcagctgaggagcgacgtgggcgcaagctgtatccagatgatcaagtcagcgtggccggccaaacatacgtgatcgtgagcgcatgaaactggatcacttggtgctgaaaaattatcgcaattatgctgctgttgatacaacattttcaccagaaatcaatgttttgattggggcaaatgctcaaggcaagacaaatctgcttgaatcaatctatgttttggcattggctcgcagtcatcgaaccaacaatgataaggaactgattcgctttggtagcgagtttgcacgggtttccgggcaagtttcgcgacaaagcggttcccatcagttggagttgattatcagtcatcaaggcaagctgcccggattgatcgcatcgaacaaccgaagctttcccagtatttagggcattttaatgtcatcttgtttgcacctgaggatttagccatcgtcaagggcagtccggctgggcggcgtcgcttcatcgacatggagtttggccagatgagtcccaagtacctttataatctgagccaatataaaacgtttttgaagcagcgcaatgcgtatttgaagcagcttaagtatcatcaggccaaggatctggtttatctggatgtgttgactgactcgcttgcagctttcggggcagagctaattacggcgcgcgctaagttgttggagacgatgtcggattatgctgcaacgattcagcaagatatcaccaatgggcgggagtcattgcatttttcttatcaaacacaggttgaccccagtcttcgcggtgacagtgagcaggtttacactgctttgggcgagatgtttgccaagcagcaagcgcgcgaaatcgaacaaggaccagtttagtcggtccccagcgagatgatgtgttgttcatcgtcaatgataaggatgttgccaattttggcagccaagggcaacaacgcaccacagcattggctgttaagctggcagagattgaccttatgaaggatcaaaccggcgaatatccagtgctattactggacgatgtgttgtcagaattagatgcggctcgccaaacccatttacttaaggccattcaaaccaaagtccaaacctttttaaccaccacaagtttggaaggcattcaaaaagaaatcatcgcaacccctgcagtctttaaagttgatgaggggacattagcaagagcgtgaaccagcccggttagaaaccggagtgtaagtgggcctgaacgtgatgaccgtactttggtcattgcgttcagggtccttacacgcaggtttctgggctggtgaacgcgtttaaagcagagcgtgaacaggcacgtttagaaaccggaacataagtgggcttgacgtgatggccggtttttggccattgcgttcaaggtccttatgtgcaggtttctgtgccagtgaacgcattttaacaaggaggataaccagtgacggacaagaaagaaacggccgaagagaagaaggatgaactggcggctgagtatgatgccagccagattcaagtactttcaggacttgaagcggttcggaagcgtccagggatgtatattggctcgacaagcagccaaggcttgcatcatttggtctgggaaatcattgataacgggattgatgaagcgctggctggattcgcaacacggattgaagttgaagttaacccagataatagtgtgacggtaacagatgacggtcgcgggattccagtcgatatccagtctaaaaccggacggccagcacttgaaacggtttataccgttttacatgctggtggtaaattcggcggcggcggctacaaagtttccggtggcctacatggtgtcggggcatcagtcgtgatgcgttgtcgactgatttggacgtcacggttactcgtggtggcaaacgttactacattgactttattcgcggcaaggtgaacacgccgatgaaagtgattggcacggcaccggagcacgaacatggcaccaaggttcattttctgcctgatccggacatttttaccgagattagaacattcgatgataagatcctgaccaccagaattcgcgaactggctttcttgaacaagggtctcaagttgacctttaccgacaagcgcgcggcaacgcacgagaagctggtgttccattacgaaggcggcctcaagtcttacgttgactttttaactgagaaaaaagaaaacctgttacaagaaccgatttatgtggaaggacaagacaaaggcatcacggtggaagtcgcgttgcaatacaccaacgactatcacagcaccttgttgacgtttgccaacaacatccatacgtatgaaggcggcacgcatgagaccgggtttaaacggcgctgacacgggtcattaatgattacgctcgccggtctggggcgctaaaagacagcgatgatccgttaagtggggatgatgttcgtgagggcttgacggcggttgtttccgtgaaacatccagatccgcagtttgaagggcaaactaaaaccaaattagggaactcggatgcccgaacggtggttgaccgtaccttctctgaccacttcaataagtttctcatggaacacccagctgatggcaagctaatcattgacaaagccatgctggccagcaaggcacgtttggcggctaagcgggcgcgtgaagtgacccggaaaaagagcgggttggaaatttcgaacctgcctggtaaattggccgacaacaccagtaaggacccagagatctctgaattatttatcgtcgaaggggattccgctggtggttctgccaaatcagggcgtagtcgcctgacgcaggccattttgccaattcgtgggaaaattctgaatgtgaaaaggcttcaatggaacgcatcttggccaatgaagaaattcgaaccttattcaccgcgatgggtaccggttttgggcaggactttgatatcaataaggctcgatatcacaaactgatcattatgaccgatgccgatgttgatggtgcccacattcggactttgttgctgacgttgatttatcgctacatgcggccagtgcttgacgctggctatgtctacatcgcacagccgccgttgtatcggttacgccaaggcaaaatgacgcaatatatcgattccgatgaagaattgcaagacattctaggccagttgccgccgagtccaaagccagagattcagcgttacaaagggcttggggaaatggacgccaaccagctatgggagacgaccatggatccggataatcggcgcttactgcgggtatcgccaaaggatgccgaagctgcagatggcgtttttgaaatgttgatgggtgatcatgttgaaccgcggcgtaatttattgaagataacgctgtgtttgttgatccgaacaacattgatgcttgattgaccagtttaactaagtcagcttttgcatgagaatttttgagaggagacttttcgcttaatggatgatcgccaagaaagccgaattaccaatgtgaacctcggcgaaacaatgcgtaaatcattccttgaatacgcgatgagtgtcattgtggcgcgggccttgcctgatgtgcgcgatggcctcaagccggttcaacggcggattctgtacggtatgaatgaactcggcgtgacgccggataaaccgtacaagaagagtgcgcgtattgttggggatgtcatggggaaataccatccgcatggtgatagctcgatttatgaagggctcgtacgaatggcacaggacttcagctatcgttacatgctggtcgatggccacgggaactttgggtctgtcgatggtgacggtgccgctgcgatgcggtataccgaagctcgcatgagaaaatagcagtcgagatgctgcgtgacatcaacaaagatacgattgattttcaggataactatgatggcacggaaaaagaaccggttgttttaccggcacgttttccaaatctgttggtcaatggggcgactgggattgcggtcggtatgacgaccaatattccgccgcataatctgtcagagactatctcggcgctgcacgtgttgatggataatccagatgccacgacagctgacttaatgcaggcactgccaggacctgattttccaaccggcggcgttgtgatgggtaagtcaggcattcgccatgcttatgaaactggccgcggcacgattgttttgcgcgggaaagttgatgttcagacggagaagtctggccgtgaacggatcgtgattaccgagattccatatatggttaacaaagccaaaatggttgaacggatcgcagatttagttcatgaaaagaaaatcgatgggatcgtaaccttgcgggatgaatctgactgaccgtgacgggatgcggatcgtcattgatgtgcgccgtgatgctagtgcatcagttattttgaataacttgtacaagctcacgccactacaaaccggcttttcattcaacatggtggcaatcgttaatggtgcgccaaaagtgttgagcttgaaacagatcctgcaatattatctggatcatcaagaaaacgtcattcgtcggcggacgcaatttgacctgcgtaaggccaaggctcgtgagcatatcctcgaaggattacggattgcgcttgatcatattgatgaaatcatcacgattatccgtagttctgaaactggcgacaaggcaaaagtcatcttgatggacaagtttaagttgtctgacaagcagagccaagcaatcttggatatgcggctggttcggttgaccggtttggaacgcgagaaggttgaaagcgaatataaggatgttgaagcagcgattgctgattatactgatattcttgctagaccagaagtgttcatcagatcatctacaacgaattgctggatattcagaagaagttcggcgataagcgccgtactgaattactggtcggtgaagtgctcagtcttgaagatgaagatctgatcgagcaagaagacgtggtcatcacgttgagtcataacggctacgtcaagcgattggcaaccagtgaattcaaggcacaaaatcgcgggggtcgcggtattcaggggatgaacgtccatgatgacgatttcgttgaacgcctgatttcgacttccacgcatgatgtcctgctcttcttcaccaacaaaggtaaagtttatcgcagcaagggttacgaaattcctgagtacggtcgaaccgcaaaagggattccaattatcaacttgcttggtgtcggtgccggtgaaaagattcaaacggttatcaacgtgcatgaaggcgaaaatgatgatcgttatctcttcttcgtcacgcaaaaaggcgttgttaagcgcacaccggtgaagaattcgccaatattcgcagcaacggactgattgcgttgaatctcaaggatgaagacgaactgaataatgtcatcctaacgtccggacaagataatatcctgatcgggacgcatctgggttacagtgtgaccttcaaggaacaagacgttcgctcaatgggacgttcagcgactggggttcgaggtattcgcttacgtgaacacgattacgtagtgggttccgatattctcaaacccgattccgaagtctttgtcatttcagaaaaaggttacggtaaacggacggcagcgaaggaatatccgattaaaggtcgtggcggtaaagggatcaagacagccaacatcaccgccaagaatggtccgttggcaggggtcactaccgttgatggtaccgaagatattcttgttatgactgattctggtgtcatgattcgcttcaatattcaaagtgtttcgcaaactggccgagcaacgttaggggttcgtttaattcgagttgacgacgacgatgccaaggttgcaacgatggccaaggttgaaccggaaagcgacgatccagacgatggcagcaagccagatcagccaactagcccgacagacgcttctgatgcaccaacctcgcagcagccagctgatggttcgtatgctggcgatgccgatcagcaagtgagccaattgcttgatcgcgctgaagctgatcaaccagagcaacatgatactggcgaccagcctgaataatctaataatgctagcatcaattgagctgattcacgctcaataaaaataccggtcgaaatggcaatttgccacttcgaccggtatttgtttgcgtacagataacctcaaatcgtgaaggttgattggttgcccatgcgcgccttaagttcatggatgatcttaacgccgctgctggtaccgatgcgagtagcaccagctttaatcattgccaaaaaggtatcaacatctctgataccgccagccgctttgacttgcacttgatcgccgactgtttctttcatcaaagccacattttcgacagtggcaccggctgggccaaagcccgtcgaagtcttaataaaatccggaccgacgtccttagcaatagttgccattttgataatttccggcttggtgagataggcggtttcaaaaatgactttgcacggtacattgaccgcatgacagacagcaacgatttgacgcatttcattttcaagataactgtattgctgttccttaagcgccgtgatattgatcacgtagtcaatttcgttggcaccgttttgtaaggcgtctttggtttcaaaaactttggccgcgatgctcgtttggcctaaggggaaagcaattgcggcgccaacatcaatgtcggtacctgctagttgtttcgcacaaaaagccgattggacttggttaatcgccaccattttaaaatgatattgtttggcctcgttgcaaagctggcgcaaatctgcgtgagttgcatctgcatgtaagtttgtgtgatcaatcatgcgactgaattgatctaaagtataagctgtcatgatttttcctccaaagttgaattcggttacatttagcataccactttttgcgtaatgtatatctgacagcgataaatagtacggtgttgtgcaagcaaccatgcagaagaaaggccattgcggtcaaggtccttatgtgcaggttgctgcaccagtgaacgcgtttaaggcagagcgtgagctggtgcggttagaaaccggagcataagcggccttgggcgtgatgaccgtcctttggtcattgcggtcaaggtccttatgtgcaggttgctgcaccagtgaacgcgtttagaggaggagaagcgaatgttgaatagtgtgagtctaacagggcggttgaccaaggagcctgaagttttccgaacggctaacgagcttgatatcgtccgatttacgttggcggtgaatcgcgttttcaagaataaaacgggacagcgcgagactgattttattgagtgtgtcatttttggcaaacgcgccttaacttttgcgggatcaactaccaaagggtcattgttgggtatttcagggcggctgagtaataatcattttgaaaataagcaaggtgagcaagtgtggcggaccgctgtcgtcgttgataattttgcttggttggagtcgcgagccacgacggaaagccgccgggcagggaccttgcaggcgacaggaacagacgacgtcatgccagtagaggaaggcaccccgccacaggtcgcaaccgacgatctgccattttagtggtggtattcgccgcggatctatgctacaattttaactcgtgagtatccggctattctatagccttagtactctccttgctccggcaaatgaccggggcctaaagtccataaggaggtgaatcgtcatggctgaaaccaaatatgaagtcacttatatcatccgtccagatttggacgatgctgcaaagactgaattggttgaacgttttgacaatattttgaaggaaaatggtgccaacatcattgattccaaggattggcaaaagcgtaagctcgcatatgagatcaacaagtacaacgaaggtctctatcatatcgtgaacttgtccgcagaagatgacaaagcgatcaatgaatttgatcgtcttggcaagatcaacaacgatattctgcgtcacatgatcgtgaagcgagaagactaatcgtaacttttttgaaaggggcgctacggcatgcttaacagtgttgcattgacaggtcgattaaccagagacgttgatttgcgttacacgcaaagtggcacggctgtcggttctttcacgctggccgttgaccgccagttccgcagtgcaaacggcgaacgtgaaactgacttcatcaattgtgtgatctggcgtaagtctgcagagaactttgcaaacttcaccaaaaagggatccatggttggagttgaaggccatatccaaacgcgtacgtatgataacgcgcaaggacaaaaggtctatgtgaccgaagtcgtcgttgaaaactttgcgttgctggaatcccgggcaacgactcaacagcggccgtccgaaccggcaaatccagctggccaaggtaatcagaactatggcggcgggcagcagtttggcaataaccaaccgcagaatctgccaagttttggttcacaaggcgccccgaacaatgcatcatcatcgaatccgggtcaaaatccggcagcaagtcagaaccaaggaggcaactccgcggctaaccctgctaatcccgatccgtttgctaataatggcaagccgatcgacatttccgatgatgatttgccattctaaggtgtgactcaaagtcgcactaaccgcggtaatcccttcaggcgaagggttatctaagtggaatctttgataagggaggaattctcatggcacaacaacgccgtggtggccgtcgtcgtcgtaaagtcgacttcatcgccgcaaaccacatcgaatatatcgattataaagacacgaacttgttggatcggttcatctcagaacgtggcaagattttgccgcgtcgggtaaccggcaccagcgctaagaaccaacgtaagctgacgatcgcaatcaagcgagctcggattatgggtcttctgccatttgtttcagaagattaattggtattcaaaaggacgttcctgcttaactggcgggagcgtctttttttgtgtgagcgtgaattggcgcgggtagtaaccggagcgtaagcggcctaagtcgtgatgaccggtcttgggtcattgcgacttaggtctttacgtgcaggatactgcgccaattcgcgcgttatgatgaattttgacgcctttaattgttattttcgatcctgtcacaaagaagagaagtgtatgagaccaatcggtaaaatagcaagcctttttctcgaaataaattgaatactggctaaaaacattttctatcatgaagcagaccaatgtatgacgattgcagtatttatcacaagcttattgttatataaaataacgagatagttctacaatagcggtgatcaggaatacagggaaaaatgacattattggttaatagaggtgatcaaaatggggctcacgttagccacgattccgctggctgtgacgaatctgtcacgcatgcagtttgcggtaaccgcgatcacgcattttctatttgtaacaacgaccattggcatgttgttgacgacgatgatttttgaatttatgtacgcgtatggccgtggcgatactgaaaagtatggccggctgaccttattcttcagtcggattttcttcttcagttttgggacaggtgttgttaccgggctgatcatggagtttcaatttgggatgaattggtcggcgtttacgcggttgatgggtgatgttgccggtgtaccactggcgatcgaaagtatgatttccttcttcgttgagtcgaccatcatcggtttatggcgctttacttggggtaagttgccaaaacgagcacatgcttggttaggcgttgggatgttgggtgcatcgcttttttccattgtctggatcattgcaatcaatgcattcatgcaaaatccttatggtttccgtctggaaggtggccgtgcacggctcacgagtctgattacgttattacagaacccgcaatatcggccggaatttttgcatgttttattcacgatcctgatcaccggcggatttttgacagcagggattgctgcctggcagattctgcacaagcgtgatacgtcagcgttcaaaattgccgttcaaattggcttactcattgctttgccagcagcattcttacagccggcacaaggcgacgatcaaggtgccgcaacagcagcgttgcagccgatgaagtttaccgcaattgaaggccggtatgagaccgaaggtagtcccacaactggggcaccttgggcgatggctgcgctgatcaatgaagacacgcacacaaccaaggccgtgtcgattccgaacatggggacttacttcggcaagaacacgttcactggcaccatgccgggcatgaacgctgttgccaaaatgtatcacgcaaagttcgataagacggttgccaagtcgtacgatggccagatgacttattatccgccagtgaccctgctgttctggaccatgcatttgatggtttatgcggggtacttcttcacgatgttcgcgttgtttgcgacgatcatgctgcatcggcggcaatcggcaatcgaagatcatcccaaaacgttgcggacactcggttgggtactatggctgccatatttgaccttcacatctggctggatcgttgcggaagttggccgatatccatttgtggtttatgggctactcacgcagtacgatgcggtttcaccgagtgtgaccgtcactgaggctggtacaagtctggccttgttcttaatggccgatatcttcttagtgaccacgatgatttacatttcacatcgcactgttaaacgcggtttgccgcaaatcaccggtgattatccagaagatcgcacaattccggatccatttgcaaaggaggcgttcagtcatgcctagcctttcaaatttacaagtgatctttctaggtatcatttcgactgagctgatgctattcttcgttttggacggcgctgattttggagccggcatggcgacattctttgttggcgatgatctatccaagcgtcaacaaattatgaaggttactggaccagtttggggcggtaatgagacttgggcggtcaccgcctttgcagtgatgtttgcggcttatccggggtggtactcagcgttaacatccggttattacccactcatcttccttatgctgttctttctgatctttcgcggggtctcgtttgattatcgcaatcaatggcacagtcgccactacaatcgcttctgggactgggcacttttcattggcagtttaatgccaccattcctgttaggcattatctttagttccacagtaagcggcgtgccgattcgcaatggcttcgtctacgccagcatgggtgacattctgacgccattcagtatcctcggcggtattctggccgttctcttaagcctgaatgttggtttgaatcgggtcatcaaaaaagttaccgaaccggtagcaacaagtttgaccgttgcgttaaaacgaaccacttggatcctctatccagcgctcgtcttgtttgccatcttattgccgtttaacacgcagttctttaccaaccggcctgtcattgtcacgttactgctgattttactggtggccttcctcggtgttgaaacgtgggcaatcagccaacaacgacggcgtgtagccttttggcttagtgtcggcaccatggccagcttcatttacaccatttttctaggggtctttccaaccctgattgttggccgaacggcgggtacctccattacggcgttaacagcaacaagcggtccggtttctctgttatggacagcgtggttgttcggcttcacgattatcttgatggtgggtttgcaggcaacagcctatcacctaatcaataagtactaccacgagccggcatcgccaatgatatgagcggcggcgaaaagaaggtgcatatgatgaaaaagatctggatcaatatcttctgggggctgttagtcgtcagcttctggctctatcagctcttctggccattattctggaacccgatcagcaagttctatggcatggtggcgttgtacagcattgctgccattgctttcggttttgcagttcgggctacacttaaaggctatgggcgccagaaggcttgagtgttatgaacaaagaaaaccgctgcgacttcatgatcgcaacggtttttttgaatgctgatttggcgttggttattggctgacttgatcgctgtctgatggtgttaaaaaactcaggatgatcaagccgacaaaggtgattgagatcccaagtgctggataaaaatagatgccaatagcagtgatgacaattgatagtgggaaaaagattgaggatagaaatttaaaaggaaacatctgcgcaattttttgactaacagcagtatgcacgtgttcaggtgtttttctaatggcatctgaaagccatagatacgataaactccaaaaaatgaagacaaacaaatatagatactccggtccagtagcttgtggaaacttcccgacccaaccagttgcgacaggcagtaaggacatgctaaaaagccacaagttgttaatccaataaaccttttttgatattctgagggctaaggcaaacatgtagtgatggttgtaccaagccaccccgacaaaaagaaagctgacaatataagcaaaaaaataaggtaattgatggataatacccgtccattttgcggtttccggggttttaaactcaagcaccataatggtaaggataatggctacgactgcgtctgtgaatgcttcaactcgacctttattcattttttcctctttagcgtaaacttagaatgatttgacaataagattatttgatctgagtttactactgtttgtttctgagggcactttttaaaccccaaatatgggtctgaagaagcggacagataagcaagctcactaagcgtttttcagtttctggtgaaaaaattatctctctcaatttgaaaaaatttctacatcatttattgtcgagcgtcgcagcagcaaactttcctgaaggcatatttttcatcgcggatccctgcagtcaatattgtgcgattttcgactgtcagtcaaagccataaaattgaaaaagcatgcgttgggaaacaactgaaaaaggtcgaagctacgttagccaatcgacctttaagttgagaaacgtgaattattttatttgtgtttttcggagacttgaagactgactaaaagactattggagcataatgaaaacaaaggtattagaacaaatgcgtaccgtgatttcatcaaaaaaatcgttgcaaaacaaacagtcatgatcaagagactaccaacgtttgaaaaaagatacggttcatcacccttaatatgcttaataaagttagcatttccatagataagcaagaatatagggatcattaatagttcaggactgtgcaacataccgccgagaaaaaagagaatataaccaccattcagagacaaggcgatcttaccagtttgatcttcggaagtgtgttgagcccatagcagcatgcctaaaatagagaaacgcaaatacattttaaaagtaattttatcaagcaataaatcaccccgccaagaaaacgctttctaaacgatgggatacacagagggaaacgacttgtcaatgtgttttaaaatcaatttataactataaaaatataattaatatataaatgaggcgatagttattgaatgtattgcttgtataaacacacctgaaatttaaaaagcgaatcaaaagtgaagcaattgttcagtgtgagaccgtcatttcatcggtgactgcttctacgttcatgtctgctggctcccgcgatggttgcaagcagaagcaggactgccgccgccaaagcaaaccaagtccaaccggcaatgggaacatgggcatctgccaaatagccaaagccatacatgataacaaggtggccgccagcaaggactagtgcagcgaacgtcatgctaaggcgctgccagattgtgacggcgttggtgaaccaagccgtgaccatgactagtagctgtgccagcagcaacaaagccatgggaagctgtaaaattaaattgagataagccatcgtatctgtctcctttaagcgtgccataaaggacggatcagtttcgcattttggtgcctatatcctaatcataccaacaaaaattcaggcttgatagtgttatactacgtctcaattgcagacaggtagcggggttggcatactatgagacattagcagccagcaaaaatatcacgcaaaaaaaagcctgtcagaggatcaactcactgacagactatttttctaaagcagacgtagaggagtgcgttcgttgaaaaaacaatatcaaccacgtgtggttatcctaattgttggggaagacttttaagatgatgtttatgcagacgcacgacaatcataataagcagaatcagtagcattattgaaatagccccacgttcaataccaaagacgccgccattcagccattgtgtattcgatgtcggtgtcgaggtgataaataagcggatggcaggaaagccggagatgactgtcccgaagataattccctccgaaaagtgccatgctgcattgatagcgctacacagccaaatattaccagagatcaatcgaatttcggacatcaaaacactgaataagaatagacttagtgcagcatagacatcaaatcctgcattaacgacatgtaaaaaaacatacaaaattgagtttgttaaaaaagcgaagacaacacgtttctttttaagccaataccccatcagatagccacggcatattaattcttcagcgattgcctgaatcgtatagccaatcaaaaagagaaaaaagacgggtagataagaccattgatagttgaagattagcttgtaaccacccaaaagtgtgatgatgccccagttaatgagaacagctgacaagccgattaatgaacctaacacacaagttttaaaagcgactttagttgaaaatttgatcatttgcaactggcttttatgacgttgccacatcaaataggcacctagaaattgagctacgaaacctattagtatgataaaacgcgtatccaacagtgttgctgtattcatggatagcaaaccaagcaacataccaactgcaagtgaaggcagaattccccagccaatcgctgtcagtgacaccgctatgatttctttaagcaaagttctgttatcgaccatatcctcaccataaaaaagagtcctgtataaagtctaatcttcatagaggattcttccctttcatgaaaaataagtaatattagtgacgtggaaaatttcgatgattgccttcgttaaacccagcgacaatatcatcaatgtggccaaatgcttcttgagctaggccaattccgatgtcaacccaacctttgcgtttgctgccaccggtcacggcagcgcaatcttgaagtgaaagcgtggaaaacatagttaatgatgtcatggaatacctccgattttttcagtatttggtagcaacagggaaacaccagatcagcaatgaccaggtccgccatatttatgtgcccggcagtaacctgcatcacctgctgcggcccaaatgatacctagttctttgccgacgccgcgccagaagtcacttgagccgtcccctccaactacgagttgaagctcttgcatacttaattcggttaaagataattgttttaccattttgtccctcctaatatttagccttgcctaacttttgaaacgcagtaattcaaggagctagctgtcctaaaaacaagttacaatagtgcacaggatttttggtgagttttatataaacgcttgttattcgccgataaacgttagaaaatttgctaaaatgcgtaaaaagtgacgttaaaagctatttttacgacgttcatttttaagagaccatgcccaatggctattagaagaggtagatcgtgagtagtcctgatttaatcgggcgaatagtttttatctcaacaattgcgatactgtgatgttgcgtatgattgctagcggacgtcccgaacaagcaaactagttgctgataaacttttctcaatgcaaaaaagaagtcacaaggaatgcgatcaaacattctttgtggcttcttttagataactcggtaattttaggttgggaccgtgatgtgatcccaagacgtgattaagggtaggtaaaaattaccggtggatataaacgtagctgcttgcaccagagatggtttgggtgttcgggccggttggtgagctgaagcccatgccgccttggctgatcgtgacactgtcaccagaaacagattggacataagcaacgtgaccatatgaaccatcggctgtccattgaccgccaacggattgaccagcggcgaagacgatgattgagccggctgctggtgtgtggttaacagtgaagccagctgctgcggctgaaccgccccattgtgcgccgttgccccagccattaccagcccatggtgcaactgatttgacgtaccaggtgcactgaccccaaggataggtgttacctgaaccactgaagtcagcgtggctgccactgcctgaagctgtgttgttggtgataacagaagaactgttgtttgaagaacttgatgtgttgttggcgatggtgctggttgaagttgcgctgcttgaactgctggtagtagaagaacttgcggttgaagcggcaacggtcttcaaagcggcttgggttgcagcagctgcttcagactgttcttgggcaaattggctttgcaaagcaaccaactcatctttatgatcagcaatttgcttattcaaagcatcttgtttatcgttagcatctttttgtagggaaaccaactgtgatttctgggtttccaatgaagccttagttgaaaccagcgtctgacgggcattttcctgttccgtcttcaagccagctaatttatccttggcaactgtcacggcatcaagtgcatctttgctggcttggctaagtttgccaaccgtcatggtgcgggcaattaagtcagacaagttctgggaattcagaacaaagtcgatatagacattgccgctgacagagttgccagcctttttttgcaaggagatcaactgatctttcaagttgttcttgcgtgctgtgacattcttttgagcggcaacaatttcaccgctgagtgatgaaatcttggcatcagttgcgctgatcttagccgttgcatcgctgatttgaccattcttggtatcgatctgcttgttcaaattgataacttctgtgttcgcatcttcaatttgcttcaacagtgcattggtttcgcttttgttggaagcgatactgtcgcttgtatcagcgaaaactggtgttacggcgctagcagaacctgctaaggtaactgcagcaaccaacgtgatcatgactttattgaatttcatttttgacctcacccttaatttgattaactaaaggctactttactgtgtcaatgttacgtcagcgttacaggactgttaggagttggtctcaatcttcatttgcgcttcaaaattgcgatcatgaacgtttttaatcccaatttttgatgaattttgtatgaaaaaagcagcgccgtgacgacgctgcctgacaaaattgtaagttattcgtttgatttcagggcttcgaccatgtccacccgttggagtcgacgatgcgtgagccaggtgacgatgccggtgaaggccaacatgagtaatgtggccgtgaggtagccgacaatgctgatcgtgagtggaaaaaccacggcctcagtttcggcttgatacaaaatgtaggctgtcagcaaattgccgagcagatagccgaacacgatgccgatcactgtcaacacaatgctctcacgactgatgtacatggtgacctcgcgatcgaaaaagcccagcaccttgattgtggatagttcccgaatgcgttccgaaacgttgatgttattcagattgtacaagaccacgaatgacaaaaccgcactgagcagaataaaaatcaaaacaataggatctaacataccgctcatattgcttaacgttttctttgctgtcgtcgtgaaactaatcccgacaatcgcgtgatgattgagcaattgcttagcgagtcgatcattttgtttgctgctttggggctgcaagcggactagcaaggtgtttggtttcgcactattaccagcgagctggtgataagcggtgttggagagatagccaaaatggccaacgtaattcttagcaatgcctttaattgtgaatcgcttgctctgaccattagttgtggcgactttaagggtatcgcccgttgtcacgttgagtgccttagccagtttgctggtgatcacgataccgtggcgcggcaaggtcagtttgcgatttgacgccgttgaacggagactgacataaggttcaagatcgttgccgtttgctggggcaaacaaattaacatcgctcaggctatggcctttagcactgagcttagccaccgcgccgctaaccgtgcccgcgctgcgataagctttgcttttagccagaatgtcgcgggccgcagctggctttttgccatcagccaatcgcacaatggcttgataatggatgacatcaccatactgttgaacaccagtagccgtgatcgagtctttgatgccaaacccggtgaggatcaaggcggtgccgccagcaatcccaagaatggtcatcaccagccgtgatttgtaccggaaaagattacgatagctgactttttggttaaaagacagacgcgaccaaagcggcgtgattcgctccagcaaaatgcgtttggcggatttcggtgctcgcggccgcatcaaggcagccggcttttcggttagttcattgcggaccacaatggcggcggcccctaatgttgcgatcagcgccaataacaatgacaaggcgatcaacggccattgcaaagagacgacttgttggagcggaatgtaatttttatacaaactcaagacaatgcgcggaatgctcaagttgccagcaaaaaccccgatgatcccacctaataaaccagctaaggcagcataggcgaggtaattgcgcgcaatcgcccatttgccgtaaccaagcgccttgaatgtgccgatttgcgcgcgggcttcttcgaccatgcgactgaccgtggtgaaagtaatcagcgcagcgacaagaaagaagaaaactgggaaaacgttggcaatggcggcaattcgatcagcagagccgccgtaatcgccaaagccaggcagatcttcccgagtttgccatgtgaggctggttgacagttgtttgcgagctgtgacagtggcctgttgctgaaaggttgatagttgcggcttgatagcttgatcggcagctgcggcaacggcggctgccggcatgcctgacgccgctaattgtgcttgagctttggccgtagcggttttgacaatgttggcatataccgctgctcgcagatctttttcgccttgcgccttcacgcgctgtttcaccaatttcatttttgtggcaacggcgtccttgtaacggttgctgaaggtatcgcgtgtttgcaaagctgggaagcgaatgttgagctgcgaggcgaccggcatcttcatctgacttgctgggatgtaggcaaaataacgcacggtgccatcaccgatattcgctgacccacgactagtgtcttcgatgtaggctggcgaatcagcaaaaccgctaattttaaaagtacgtcgagcaagcttgctgccgccggtgaaggtgtaagtttgaccaagttgatagccgctttttttggctgccgtgtcgaggacaatctgattggcttgcgttggcagctgtccgctggtgagatgcagtcgattgatggttgtccctttttgatagccgtaaagggcaacaacatcgctggcgcggccgccgatgacatacttaaacttgacggcttctgcctgcacgccgctaactgattcagcggctttaacttgagccttactgacaccagtcgttgccagcaactgactatcagccagatgatcggctttcaccgtggtgtttagagaatccttaagtgccgggcccgtggccttgacgccgacgaacagcaggacacctagcatgataataatgacaatggcgataaaccggcccaaagagtcgcgaatgttacgccaaagatttttagttagtggtttcatgacgttactcacctaccactcaatgtctgcgacaggcgttggctgcggttcatcatgaatactgcgaacctgcgcatcattaatttcgatgatccggtcagccattttggcaatcgctgcattatgggtaatgatcatgacggttttatgatctttacgactggcatcctgtaacaactgcaagacttgtttgccggttcgataatccaaggcaccagttggttcatcacaaagcagcagcttcgggtttttcgccaacgcccgagcaatggccacccgttgttgctcaccgccagacagctgtgacggaaaattatctagtcgcgcacctaggccgacttgctttaaaacggttgtcggatccaaggcatctttgacaattgagccagccagttcaacattttcacttgttgtcaggttcggaatcagattgtaaaactggaacacgaagccaacattatgccggcgaaaagcggtcagttgacgatcagaaaaagtcgcaatatcggtgccgtcaatccatacctcgccttcagtgggggagtccatgccaccgaggatattgagcaaggttgatttaccggcaccgctgggaccaagaatcacggttaatttgccttgatcagccgtaaaattaatgtcgttatttgctgtaatgatggtttcgcccattttgtaacgttttgattcatgtttgacttcgatatatgccatgattgcctcctagcgtggatggtgagcaatgtgtgaagttcttagacgcgttcgcaggcgcagaaacctgcacataaggacctaaggcgcaatggccaaagcccggccatcacgcctgaggccacttacattccggtttctaaccgcgcctgttcacgctcttcaacacattgtccatttcataacattatgttagatttaaaccggccgttcaaggacagaaatggtcgttttgtttttaaatggacaacttgttcaaatgatgttcggaggatgacgatgtcggggacgaaggataatcggcgggttcagtatacgatggaccgatttaaagacgctttgttgcatattttggcgacgaaaccgttggacgaggtcacggtgactgagctttgtcgacaggcagatttgaatcgcgggacgttttacttacattttcaatctccacgcgatttgttcgaacgcattgaaatggatttggtcgaggcaattcggccttatctaacggttaaaataaacgatatggccacatggttggtgccgattttaaatgtcattgccaatcagccgcaagcagcagcgattattttgaataatcctgatagcgtggtgttgaagaagataacggatccaattcgacaaaaaacagaaaccagctatcaatcgtggtatggtgagaccgacaaaagtgttctcacttactactacgcgttcttcattgacggggcaattggcgtgctgacaaaatggttgaaaaatggcacggttgagcgttctgaacagattgcggcggtgatcgaaaatgtcgtgactaaaggcgcaccgcattaaattatagcaagtgaaattagacaaataatataggggaattagcatgcagaatgtaaaattaattgcgagtgacatggaccagactttactgacaagtgcagggaccttgccgccgcactttgatcgctatcttcatcgccttggcgaggctgggattgagtttgccgtggccagtgggcggccgctttatacgctacaagaaactttcccacactttagtgaccaaatttcgatggtctgcgataacggcggcctcgtttattcgcacggccaattaattggtaaaagcctgatccctgaggaaaaatatcgtgagatcgtgcaatttatcatgacgaaaacagacggtgttcctgtcctgtgtgccttggatgccgcgtatattaatgctactgatgcccaatattcaccagctcttttgccgttttatcaccaattgaaaaaggtgccggatttgttaacgcagtcgctggcagttgataaggtgacgatttattttccaaataaagacagccgcaaaaattccgaacgttatttccgcccagtatttggcaaggattataccgttcaagtcagcggtgagacttggctagatattcagaacctcggcgtgaacaagggccgcggcatgcgaattctgagtcgtcattttgatattcctacgacacaaatgatggcgtttggcgattatgataatgatattccaatgctcgaaacggttggctacagttacatcatggccaatgcaacgcaaggcatggcgcaacatgccaaatatcgcacgcggagtaacgatgaattcggcgtcttgcatgtgatggatcaggtgttacaagcgcaagaaggctaggctaatggcagttatctcaatacgtgtggcaattggtgtatacggctttttgatgttattaacagcgtggcaagcatggcagaaaaaacaaggggatgtccgtttagaccaactgacggccctggctgcggcaattattcctgataagttcagtgcgctcaccgttttattgattgggttattggctttgtccacggtgacatggttcaatggcgtcgcggtatacggtaaaccgcatgtgaatcatcacatcatcagattactggtccatcttgttttgtttgggttagcggtgtggctgttctgagtagcgaaatcagataaaaggttggttgttgaatcaagttttttggtagctagttgctgatagatcatacataatgggcagaagaaccttagacaacttctaaaaattttggttcaacagcctcattgttttttatgattgtcggttgttatttgtctttttaaaagaactgaatcatacaatgccttcagatgttagaaatctaatgaaaagtgggtgaaaaatgtgactttggcagcgaattggattgttgtgatcttttcattactttttgtaagtctcggtttgtcagcttatacgtattacttaagatataggtttaaatacgatcctatgagtttaaggcgggcttttaagagtgatgctaccagcccttatcgatttggagaaagcagcaatcctcaaataagtgtgttggcacattgggcaaagatcgttctagttggttacgctttaagtgccgttgctacgttaggcttccttatgatcattcttacagaaactatttccaccggtacgatagacaattcattgttggctattggcgtcttctcctttactattgttttgggcattgtatcctatgtaatcaaccaaaaaaagttgatgctctagatgaaggagtaccaacttttaaaaaagacagaagagatttctaaaacaataagggaattttttgaagggcaaacaccttcaattggcttgagaatactaaatctaggtatcattaatttagttttctttgaatcagattttaagccttgttttaggatgcttttgaacgatccgttagagtataatctaacggatcaatttttgaaggtttatcagttagtaatcattgagccacaagctgtagccatgttgtcaatatcgcagtcccaatcattaacagtatcttgctgagaatccagcgtttctctcctgcagtattctccactagagaaatattagacaaaggagaagccaacaattttttgtgccgaaattctagcatcatctgcacaatggttaaaataacaaacaagacaattgatgtccacaaaatcattacacggacactgtcgtccaaagaaattatcagaaaatcgtttattgaatagactatccagccgcctaagaaaaacaccaatgataaaatctttgttgtgctttccaatttgaccaattggtttaccttcttaaataaagttggattttcacccagatatttagctacttctatataggcttcactacgcttttgatgcgcagcttgtcgccgtaccagtgttgttaaaaaaagagaacttaataacactgtgaatccaagcacaccaagcattaattgtaacaactccaattaatcacctccttaaaagctaagcagcaatgaatgtcgctggtaatagtttagcagccgttccaacaagcgtagccgctacttctggagccataataattgttgctattaatacaacagctcctgccgcccaaggaatccactccaggtttggttcatgttcagaaacgggaacataaattggtttataatcctcagctgggatccccaatccatttggtttagtgtatatctcaatactcaatgaggttgtaacattttcctgttggccgttagtaacaactgttgttgtagactcacagaccactttaaaccccaacattccatttttagttgacattccaacctttagatttccattgccaatcattggccccagtgtaccaagcaaagccgtaaagtcaaaattccttgcagcttcgtgcgcctctttgaatttatcgatctcagattgtacttgagtgcctaatttgccattagaaattgtaaaacctagtggagccccactgtcgttgctcgcaaaagtacttgatagtttaatataaaactctgccaaaatagttgacacatgaatttcagggccatcaacctctaaggtcggaatatctggttgtaatggttttaactgataggcattattaattaaggtgcgggcaaattcaaggcgtactgcgttaggatctactttaaaagttccacttccttggtctttccctgaagaagctacttggtcaatatcaacacctgcagctgagtattccacaaactgatcaaaggcccaatttttgggcattttaaaacctaggtttccgctccagccatatgacatatcagcgacgtaggaataaagaatattggttccagatgcagcggttacccgattacatacattccgtgttccatatattccaattttgaaaatactattgttcatagcttggctaataccacggaaataaggaataattgtgccatctatatcgccactttgaacatccacatcaactgcaaagtaaatcgtagttgcagccggaaaccctaacttagcagcagtactacttgcaacaaatccgtcatgaattccctgctgtagactaaagtaatcaagctcatagccaccatcttcatatattggcacaacttttagtccagcctcagtaagatttgcaagttccgtggaagtcaagtatttatcacgttcggcagcccctgcaccaacgctgccagttagataacgagcaactattgaaaaatcgaattgctttagttgttttgcctgtgcagcacttaattgagttgctgtatcaaaagtatttgaatcacgattagtattgccgttgctagtcaacaatcctttgatgacggttaggtcagctgtgctattaaatggcggtaaattcataaactttcgaaaagctaccactgccgttgctacgtctgaactaaaatagccatcaaatgcccctgtataaaagccgttcacatacaagccgtattggatgacctggacaacgtcgctattggctccctgattaacagtaggtgtagcggcaattgtccctggaccatagttaccatttgcttgcgcagaactcataccgattgctcgttgtaaggcataaatcaacgctgtattagttgctcgttgataaacgccatcacacggcatcaattcttgtaattccccagagaatttacggttgagcgcttgctgcatggttcgaaccttagcatcgccgcttgaaactaagacgaaagctgccatgtcaaacaaagccgccataaatgccactgtcacagagccatcagccgcaatgccagcatcttgctgaagttctttaacagcattaagggtattattcgtgaactcattattaaagtctactggactaattcctttgcaccagaaagccccttgaatgagttgagcaatgttccccttatatcctggtttcagactacctacaacaggtgctaaagcatttttggttgtatcgccaaagccttcaccaatagcactaataccgatttcgtgctgtaatcccattctcaggctataaattgttggccaacctgtttgtccgttttctggagctgcgacaaagccaggaacactaccatacgttttgttgagccatttttgaacggctcgtactgcttcatctgccattttaaagtctcctttattatcaatgtgtgcaacacgtctgttgcagtataacgaacatgtgttcggtatcactctacatccattgcattcttttttgcaaggaaatgtttttgtttttgggaggaagaccgtctgctcttgacgctcgatattatctcggaaaggctttgtaaaaaattgctgtgaattgctaaaaatattgaaatagagtgggtcatcaaaaaggctcggcagatatacaagcatctaccgagcctttcactttatgggttctataccaattcgccagggaatcggctgtttcgaagggacaaaaataaataatcccattttttgacctattcctaaagataagcctgcgcaaataacttagctgctaacaaaaaggctaaggctgcgatgatgaatcgcaacagttggaccggcaggcggcgggcgatgatggggccgatatagccaccgatgaacagaccgataccaagcgggatgaccatgagccattcaattttggtggtgaaggcgtagatgacggtggcgatggcattggcggcgaatccggtcagattcttcatagaattggagacgatgaatggttgatcaacggtcaaggttaaggttgccagcatgaccacacccgcagcggccccgaaatagccagcataggcgccagtaacgaaaatgacgatggtttgagcggcttcttgtccaaatgttaaggtgcgtgcaggttctccgggacgatgttcttgagttggcagtcggccgctgaagagtagtaacaggcccgcggcaatgatgaagaaaggcacaactttttcaaatgtggctgccggggcgatcagcaacaaggcactgccaaaaatactaccaagtgataccagtaagatcagccgccagagaaatttaccgcggccacggagctctggcagtgaggatacagccgagccaaccccagtgaaaacgagtgccgcggtatttgtgacgttagcaatgaccggcggcacgccaattgcaagcaaggcggggtacgaaaccagtgaagccaagccagctaaagtagacgttaacccagcaccgatcccggcaatcagtagaaaggcaaagatcgaaaaattcatattgctcctccaagaatttgaatggacgtcatctagcgcatctagaaatgccatgtgtcaggtcgtactgtgaccatggggatgcgacacacaggtcttttacgctagcgaacgttgataggtcaatcatacgctaaagaacagtcatttggggttatgataaaaagcgaagaagggacagatgtacatgtttgaaaatagtaagagtcgacttgatgccatttccgacggcgtttttgcggttgtgctgacattaatggtgttggacatcaaggtgcctaaaacactgaccatggcagatctttatgcgacgggcttctctgtcgtcatttactttatcagttttgcggtggtcggccaatactggacatttcaccaagaactactacataccgttacgcaaccgagcactaatttcttagtattaaattttttctatcttgtgttcatctgtttagtgccatttgcgaccagtttcatcagtgaccatccaggcagtcggatcagtgcaacattatttgccatcattatttttatggtcgatttgtttcaatttattttgttccgatccgtcattggcgaacgaccgaaaaaagaaaacttaaatgcccatgattgggaagagtatcgcgcggtatcactcatggtgctcgtcgccattgtctacattctggtgggcttgctgctgccgaagtggattcttgttgtgattgccctcggtttaggcgcacgaaccttgaataatacaatcggacgccggcttcagcgccaaagcaaagctaagtaaaggcgaataatttttcgcataatgggaaacgttcttttctttcccatgaatgacctagtgagctttaaagaccccagtgccatgccggagattgcggagtttggcacggctgagttagattgttcaatttttccgaatgtaccgattaagcagcaatcccaatgcgatccacaagatggccgcgatgataatcgtgataatccagccgagtggttcgtgggcgaaaggcaggggcacgttcatgccaaaaaagccggaaacgatggtcggcacggtgagcaaaatcgaccatactgtcatgaaccgcatgatgtcattcaagttattattcaaaacggtgttgtagctatccgttaagtgatccaaggtgtgggaagataagttcatcatttccgcaatctgatcggcttcaatgatgacatcctccagttgttccccttgtgtgccagtgatgccaggcacacgggttgacgcgtggatctgtttcaaaacagcggcattttggattgttgctcgaaccaaaaaatcagcgctcaaggcaagttcggcgattttcaacaagtcttttttggtcgtgtgttcacgtaagcgtgtggcaatttgacgacgagtggcgtcttgctgcttcaccagtgtgacaaaattatcggtgatagcaagcaggcattgccacaaaaggctgtacaccgattcgctgccaaattgcgtaaccgttttggcgatagtcgcgttggtattgttcacatcatggctgccaactgtgatgaggcggtcatcggtgacgagaaaagccatgggttcagaaaggtagccatcggtatcaggtttatcgctaggcacattgtaaatcagcagaaaagtatcactctctgcatcgtattccatatgcggttgctcgtaatcgtcacgggcgtatcccagcatttcatcggtgataccaaaatcaatttgtaattgtgtcagtcctgacgcatcgtcgcgcgtgaccggacgccaggtttcagtaggggttggcattagcaaaagtccttttcaaaacagaagtgagcggtaagcagcaggtggctagttcggcgataaggccttgatagcggcggtgatcgcgtgattgacggtattggcgtccaaaggttggtcaaaatacaagaagcctaaaatcaagccaccggtcatcgaccatattgttcgcagaatatcttcaagcggccaatcaacaatcaaaccgcgctttaccatcgcgttcaggtcatgtgtcatggattcccaatactgggtggtgaaaccatcaacgacctgagcccgcacctgcgtatcattcagtaattccgacagtacaattttgatgatctgggcattatcttttaaaaaagtcacgcgatcctttattaacaccgtcaagaaagtttccaatgagacatagtcctgatggaggcgagacttaatgaaatcgtccaactcatcagggaacatttgactcagcaccggtgcgatgatggcattgagcaagccgcgtttattggtaaagcggctgtaaatattcccctcggccaccccagctcgcaaagcaatttctttggtactggccgcggcgtatcctttttcagcaaaaacctcaatggccgcaatgatgatgagtttctgcttagcggtgaaattggtaaaaagttgcgtctgatgcaagatgttgtctgctgagctggccatacgtcaggatcccttctcatgggtttgagtgaaaacttaaagtcaacaagttggtcccattatagcacgcagcctgttgccccaatagcgattttggcgaataagttaagcaagcctaacctttttcttgacctgtatccaaaagggtgtatatttatgtcggacgatgttgagtaaatactcaaattagacccaaatttcaagccaatggaaagagggcttcacacaatggcatcagaagataaaaaatcaaaacgcgaacacattattcacttcgaagatacgccaagcaaaagtcttgatgaggtgaatggcagtgttgaagtaccgcacaatgcgggcttttggaaaactttagcagcttacactggcccaggcatcctagttgccgttgggtatatggatcctggtaactggatcaccagtattgccggtggcgcttcatttaaatattccttgctatctgtcattcttatttccagtctgattgcgatgctgctgcaagccatggcggctcgtcttggtattgtgaccggcagagatttagcgcagatgacacgtgatcacaccagcaaagcgatgggcggttttctttgggtcattacagaacttgcgattatggcgactgatatcgccgaaatcattggctctgccattgccttgaagttactgttcaacatgccgctgattgtcggcatcattatcacgaccgctgatgtgctgatcctcttactgctcatgcgcctcggtttccgtaagattgaggcggttgttgcgaccttagtgctggttatcttattggttttcgcttatgaagtgattctcgcgcaaccaaatgtcccggaactgctgaaaggctatctgccacacgcggatatcgtgaccaacaaatcaatgctctatctctctttggggattgttggtgccacggtgatgccgcatgacctgttcctcggctcctcgatttcgcaaacacgaaaaattgatcgcacgaagcacgaagaagtcaaaaaggcgattaagttctccaccattgattccaacctgcaactgaccatggccttcattgtgaactcactgctgctgattctgggcgcagcgctgttcttcggcaccagtagctcagttggccgcttcgttgatcttttcaacgcactaagcaattcccagatcgtcggtgcgatcgccagcccgatgctttccatgttgttcgcggttgcgttgctcgcatccggccaaagctccacgattacaggaacacttgccggtcagattatcatggaaggcttcattcatttgaaaatgccgctctgggcccaacgacttttgactcggctcatgtccgtgaccccagtgctcatcttcgcgatttactaccatggcaacgaagccaaaatcgaaaacctgttgaccttctcgcaggtcttcctcagtattgcattaccattcgccgtcatcccgctagtgctctacactagtgataaaaaaatcatgggtgagttcgccaaccgtgcttgggtgaagtggacagcatggttcatcagtggggtcctgatcattttgaacctttacctgattgcgcagacgttagggtttgttaaataagtcattgtagcaagcaaaagccgctcgattcgctgatcgagcggcttttagtgtcgatttatttaaaaaggggacagttgactcatcaaatttcggcgtaagggcagcgagtgttattggcgctgatgtcctagtatatagtagctgaaccagagccatagtcattgtgataacagcaagtattgccgtcacgaaggagagtggacctgcgttcaattgacatcagttataccaagtcatggtggcaaagctcaaaccaaatgtctgaacagcgtaacgattcgaccgggcactcgtcattttgagctcttcttgggaaaccggtgaaggcttaacgtaatagacagtgccatcattgtcatgactatacgcaggagcataagcattttcggatgaccgcgcaatcttcgcgcaaaaggcactttgaaagtatccatgcatcaagagctgcgttctgactgccagtgttggtgttaggtgaccgagcacaaaaaggccaatgatggtgccgatgatcagtttaagtacttggttcgacgaaggtttagtataggaaaaaacgcccatttcttgaaccgaaaagagagctttatgagcttaaatctttctcataagccccttaagctaagtcgctatttgatcttagctctcaattgacttttgacatgccattaatttatcaagtgtctctgtatacttttttctgtctgctgcattgaggccattgaaaacggtgatggggacagaagtattgtacttttgaattaggttagaaatatctttgactaactctgccagaacattactagacatagtgttttcgtaatatccacgttttggagaaaccaaacgaccggttgtccgaagtcgccgtaatacgccagcgatttgtccgtcagaaaattcttctttaaaagcagtgtaaatttcttcagctttaacaatacggtgcttttctccaacaaattttgtgatctgagacgccaaattatttgattccattttgattttcccccttgcgactaaaaagccagaagtataattcatgctacgaaccgattttatccccatatgttcaacatgtcaaacgtttaaacaagcaacaatatcgactaaatcataaaatgccaaacattccaaaaatgaccatctaacttaccacgttcgcctctcccttttacttttcagcatcattagtacgaaccagtgctatcataaagtcatctgaaaggaagcgtggctatggatcagtttgtgaatcacttgagttgtacagcgttgcttgttggtaaaaaggcgtcggttgatggatcgacgatgattgcgcgaaatgaggatgctagcggtgggattaatccgaagcgtttcattgttgtgcagccggctgatcagtcgcaacggtacgtatcgacattcaatgggtttcagttggatttaccgcaaacaccgttgcagtatacttgcacgccggttgctgatcaaagtcatgggacttggggtgaagctggtatcaacagcgagaatgtggcgatgagtgcaactgaaactgagttcacaaacaccacaatgctgggattggacccgcttgagccggacggtattggtgaagaggccatgttgacggtggtattgccttatattcacaacgctcgcgaaggtgtcgaacgcctgggcgagttggtcaccaagtatggtacctgcgaaagtaatgggatcgccttttctgatgctaatgaaatttggtattttgaaacagttggcggccatcactgggcggcggaacggattcctgatgatcgttatgtgctggctccgaatcaaactggtattcaggaaattgactttcaggcaccggaacattacaagtacagtgctgatctcaaagactttgcagctaagtatcatttgaataaggcaaaggaagggttcaattttcgagacattttcggtgaagatacgcaggccgatcattattacaatacgccgcgggtctggtatgcccagaaaatgctgaatcctgaaattgatcaagatcctgaaagccggacgatgccgtttagtcgtgtcccgagtcacttgatttcagtcgaagatgtagcgatggtattgagcagtcattaccaagccaccgactttgatccttacgggcagaccggcacgcctgagacgcggcggcgctatcgtccgattggcatgaatcgcaatcaagaaatgcatattctacaaattcggccaaatatgccgaagagtcacgctgccattcactggcttgcggaaggcgttaatattttcaacagcccggtgccatttttcgccaattgcacaacgacaccggagaatttccagtacacgccggttgataaaagttcaaccgatagcttctattggctcaacaagctaatcgctatggtggctgatccgttgtttgcggaacatgactgggatgccgagttcgccgtatctgaaagtcgcaagtttggtttcgctgccggccgtgccgctgtggccaaaggggatgcggcttttgccgatgtcaaaccagaagatctgccagcgtggcatgatgcgttgaacgctgaaacggcagcgacgatcacgaatgacctacaatacctcttacaccagctggtttgcatccgcgcggagaaaatgacaccaagctttgaaaaaggcggggaactttaatcggactgcgaacttagcgcaggtgcgaccggtaaaagaagcagtatgtcaaaaaaataaacgcccagtctcactgacggattttcatcagcggggctgggcgtttataataggcaatatgcttttgacaagtatattgacagaaagaaggtcatcgcattaaaaatacgaaaacggaacgctggatcggtttgatggttggcttagttctgaacgctgccggaaatggcctttgtattgttggggctatgggcagtggcttatggacggcggccgccattaacttgaatgactggcaagggtggaatattggcgcggtactgtttacctttggggtgctgaacgcgctatcgaatctgttgttaattcggcgctgggattggccgcggttgatcggcgaagtgatttatacactgttcttcagttattttgtcaatgtctttacgtggctattcacatggctcggacttggcaactggccaatggtggcacgcattttcgtctcctgcttcggggtcttctgtttttgtgtggcgatttcgctctatcaacgcgccaacatcatcatgcatccaaacgatgacaccaccaatatcctgagatttctctattttaagggcaacgccactgcttcccagattactgattttatccccccaatcatcgtgatcgtagttgcgtggatcgcgacaggtaagctcttaggcatcaatatcgcgacattgttctcatttctcggcaacggcatcatcattgcatgggcagacgagcatgtttggccgcggttggtacataactttaaggtgaagcctagtggagcgaaaagatgataccaactgaaagttatgacaccaaagaagcgagcagcaagcgaacaagttagtctaaataactgttgtgagttaacatatttcccagattggtgccaaatggtttaattttaatcaaaataggttccaagtcgtcgtaaaattttgatgcgatgggcgttaagccgtttttcatcgcctcttgttgcagactcacaatgacttggttgaccacagcaacatcatatcgtttcttttctaaatcagctttggccatcagtccaatttttcgttcacgatctgaaatatcaggattcagaacgaaatcatataagttactcaatatggtttgatcgtcaatctcggcttttcctctaaccatgattagtcactcctaacgcttagtagtaaatactatctgtgcaacatattaataattgtgaaatttcattgctaataattaagccatatctttatatcaacgcgagtgtactagtatataataaatatgtaaagtgtgaagcgttcagagatggtgggaggcattattgtgacgaaaatgacgagtaagaatcgccttgtgctcattacagttgtggtaatcatcgttgttttgggtatcgctaagcttatatctgatcaggttttcaatgtgcttattttcctactcgttgcatttgctgttttgtacccagtttatctgatattcaaaagtaatcattatttaagacgcaaatagggctataagcatggcatattaaaagaaggttccgcagacaatcaagtcggctgcggaaccttcttttagtacatggttaatcgaatttaaacttaccgtgattttcgtgctgatgactgtaaaccagtcgattaaaagaaaatcttgggtaaataatacggcgttactgaacttgggatgccgttggtgacggctaggaaggtgaaaccatacaccaccatcaggaacataactagcataaacaagtagcattctttttgtcgctgcaagatggttggcgaagtccatagtaagtcttcgggtcgatggctgtcatcttcaatgagcgccagtaagcgggaatattgataccaccacgtcatgacaccaaaggaccccacgatgcttgccaaaatcagcagcaaattccgcgagccatctgattggcttaaggcccagaggcgagtcatgccaacaggaacgagattgaaaagcagtccaaactgaatacttactgcaccgacaaaaagtgtcgccgttatgatcaagaagatgcgcgaaataattcgcaatattctgagtagcagatgccgtgcgtaaattgttttcttataaaaaacacgcgcatggtagatttgttctcgggtcatctgcggaagtctttcctgctgaaaggaaatggctttctcatcttcgactcgaatgattcgtgctggcacaaagaaaattgcgaagatgactaatatgacaatcagacgcaacatgaggaatcctctctgaggttgattttgggctattattttagatagcttgattcaagaaaaaacaaacgtttcttttgcaaaatggtgagattgctaagattgtttaacacggcttaactacgcatgaaatgtgataactaccgtatggattttttgcaggctttagtataccgttaagcaagtattacctgatgtcagtatgagattaagaggcatctaaagtcccactcaacaaaatggaagttcttttgtttaatgtacccaatatttaattgtgaacaggccgaatgtcaacaggatgccaccgtgtctttagctcatgtatagaaaacggctggagaaaggaattacaatatatggatgtcctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccgttcattcgggtgataggcgtggcaaaagtaaaccggtatccgatagcgctttgtaagcgcctgatcgcaggaaaactctttaccgtgatcaaccgtcactgatcgaaccggacccggaaagtccaccatcagtcttgcaaatcccttgagaacagcattttgtgataagttttcaagcttagttgtcgccattaaacgtgtcacccgatcgacaatggtcaaaacagcagcctttgacccgcgaccaccgcgaactgtatccatctctaaatgtcctttttcggttcgccgattagctgactcactgcgaatctcaattgaggtgcctactgcttggttatagcgcgaccgaaggtcttgtcttcttttatgacgtttaccgtgatcaaagagttggcttggctgaaaatcgacttgtctttgataaatccagtggtaaatcgtgtgtggcgcacagtgaacggcataaccgaccatttcaggggaccaacctaggtttagcttctcagttaccatccgcttcaacttaggcgttaaaatcgagtgccgaccacaacgatgccgacaagtatcggcatgatcctgagctataatggcgcagtaatcaccttcagggcaacggtgaagctcatgcctaatagaaatacgagagcggcctaaggtcgcggcgatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggctttaatcatatttacaacattgttattgtttggtactttttcatcgttgtattctcattaggtgcgataacgaccaatttttcaagtgctccagttatctacctaattgatacaattttcttcttcttttttgctttttttaactttggtgcatcctattatacacaacagataagaagaaaaatgaatagcgggttgccggaacttacctttgtagcgaaagcgctaattttaatttttcgagactttggcactgcattaatatttttgatttcttacctgagggcatagtctgttgtagaagtgtaaagtatccctcaattaaatatctacgcttgtattaacttctcatagaagcagtgctgtttcgctaaattaaaaagcatctttgtcaaaaatcgtcaacaaagatgctttcataatcagcaattgtccaaacatgatttaactgtgcagacaattcaagacatattgacttgttagaaaaaaattcagtatgttgcctgttgatccgagttcaatttgcaaactaagattatgcaacggcgaagatagttttgacaacattaaacagttcaaccagtgctgcacccccacccacttcaggaagcatagaacttacgagcaatccgataacaacggttgttgcaacttttccaagatcgactgcaaacacgggatttggttcagtaacaggttgataaactggatcataggcgttttttggaacttgatctctatggatgtaagtttctaatgttagcgtatatttaccttcaacagaagagctcgaagtcgaactttcgaacgaaccttcaatcgcaatcttgaaccccaccatgccgtcacgaattgctaaacctgctttgatcgcaccgttaccaatcataggtgcaagtttgttaaatgctccggacaagtcgccgatgtcgtatgatgacatagcgctctcaaattgtttcattacatccgctgtttgattaagcatcttggcatcttgaattgttaaagtgcctgttttgtcatccacaacagtcgcggtccatttgtcttcaagcgtaatgtagtaatcggcaatgggagtagataggtgctgttctggagcagatacagtccaattgatggtaccgaacagattgtgatagtctgggaatacgcttagtaactgattcgcgagatagccagtttgtacttctggcgttgtttgcgcaacaccacttatgcctttgtctaaacctgagctggctgtttggtcaatatctatcccataaattggatattcaacaaattgatcaaatgcccagttatcaggcattttgaagcctaggttgccactccaaccgtaagacatattggcaacgaaactgaaaccaatgccgactctttcagcatgaagacaaacattgcgtgttccataaataccagtcttgtagattgattggctaagaatgttttgaatggctttgatgtacgggataactgttccgtcaatatcaccatcttgaaaatcaacatctacggcgaaatagatgaccgttccagcaggcagctctaggtctagagcagtcttgatggccgtctgagcatccttttgaccctgacttgctgtgaaataactttcaacatacccgccatcttcataaattggaaagaacttcataccgccgtcaagaatcgttttgatttctgttgaagttaaattttggggtttatagtcagtaccgactgtgccggtcaggtaacgaccaacaatgctaaagccgtagtcacgaaaatgtttaacgtcttctgctgtcaattgtgttgctgtgtctaatgcgatggaatcgcgaccggtatcgccattgctggtaactagacctttgatgacggtgtagtcagcagtaccggaagtttcgttaggatatttcataaacttccggaaacgaatgatgctggtagcaacatcgcttccaaaactttcactgaagtcaccgccatacatgctatttaaatacaagccatatttgacgattttgacgagtagcccagttgaaccaaccgatagttgaacgccctttaatgctgcattggtggcatcgccgaaatttccatttgcaacgtccgccgaaataccaacggctcgttgtaatgcgtaaattaaaccaatatttgtatcacgttgataaataccatcacagggcataatgccaagataagcgctatattcggcattcagccactgttgcaattggcgaacgtttttatcgccgccagaaactaaaacaaaagcactcatatcgaaaagggctgccattaagttgacggtgacaacaccatccgcgggcaatccggcatcttgttgaagtaatttaaaggcctgaacggtttcgaccgagaaatcttgattcaattcgctgccgggattaatacctttacaccaaaaagcaccttgaatcaattgagccatgttacccttatatccgggctttaactgatcaacaactccagaaagggcgctacgggtagtagtgccaaaaccctcaccaatggtaccaatgcctagctcatgttgtaatgcttctcgcaaggcatagatagtcgtccaaccagtatgtccatctgtaggtgctggttcaaatcccggaatacctgtgtaagttttgttgagccagttttgaactgctaatactgcttcgtctgccataatgcagaccttcttaaagttatttatcgaaccgaacgtatgttcgtttcgataaactgagtatgagctgatcatttttacaaatcaatgattatttttaaaaataactgaaagctttccgaaaacatacatactctctttaactaaaggaagcttaccttattaaaaaacgaacatgtgttcttataagggagttgtttaacttttcatatctgcctggttcttttttttaaagctaaaatcgatgtgattaaccgatcgatccaactttcattctcattagatttcagttgcaacccgcttagtaaatagtacactaacattaatatactaatgacggagggaccaagatgaatgatgagctgacgattcgaagtggcattcacgatgttatgccaacggtgtttgggtatattactgttgggatggcttacgggattgtggcgaaaaccgggcatttatccctactcatgatcgggttgatgtccttgatcgtgtatgcgggatcagctcaatttgtgttggtgagcatgttggcgacaggtagtccgattggggcaatggttatttcgacggtgttgatcaatgcgcggatgagtttgatgtcaatgacggtggcgccatacttgaaagacgaatcaatgacgcagaatgtgctgattggaaccttgttaactgatgaaagttttgcgttgtcaatgaacaaactcaattacaccgatcatcatttaaatgccccgtggtttcatagtgtgaacgttggcgcttatttagtttggtttgtggccagtttactaggcgcgttgattggtgggctgattcctaatccagacagttttggattggatttcgccgttgtggccatgtttatcgggctgttgtacttacaaatgatcacggatcggtcaaagccgtttttacggcatctgagcgtcgctggggtggtggccgcggcgatggtggtgttggtgcggtatttgccagggacgacagcgattatcgtggcgacagtgatcggttgtttgtttggaatgggggtggaacgccatgcagaatcctgaaacctttgcggcaatcctgagttgcggtttggcgacttggctgttgcgggtcgtgccgattgtcttggtcaaacggatgacgatccccaaatggctgctccattttctcagttttgtgccggtggcgattctttcggccatctttgttgaaagcctgctggtgattcatcctggtcagtggccaggcgtcaactggtcgaacctattggcatcacttccggccattgcggttgccattatcacgaagagcctcttcgccgttgtggtcgcaggcgttgcttcgatggcaattttgcggctgctgggctgggcgtaggactggaacgataagacgaaggcaataggctataagtccttcaagcgttttaacgttgactaaaaatcgctagtctggtgcgctagggtaagatcgcccgattgtgtttgctaatcacaattttgcggtctttttactgttcataaaataaagaacagtatatccaaaggaaaaaggatacactgttcttgtcgattgaggcggacatgtcatgacgcaagccgtttatcaaaccgtttacaatgaaatcacccttagaatctgcaaacatacgagtactagcatgccaagtagcgcgatcaaaaagacgagcgaccctaccttggcagctttaagtctaaaatattcgtagatgaggtaagtgatgagagagaacgggatgacaaaaacccatatcatctctagaacaggcgatcttttagggagtagatagggcatgaaaattacatagaaaccgatccagaacgtttgaaatctgaggacatgttgatagcgcttcttgaacaaggcagtccctttttcattcattcaaatcgcctcgtttttggttaagcacgacaaatgcagagatgcacaatttgagacgttgcagtgagcctacaaccaattttattataagctgggataattgattaggtcaacaattgggctttctggataatctcccacctaaaagcaattttaagcatgaagatggaatcggtatactcgtcaaattgacataggcaaggatcagtttgattttttgaggcgggtgctttttatgatcgcaatagctgagtgtcagcaattaaatacaagatcattgcttggtaagcacacatggaagacgctagaatcaatcgtatgactgagtgtttgcgtggtcttttagcgatttttaatgtagagaaacaatccagcctatgacaatgacggaaatgagatagaaaatctgcagaacgattgcaccgggtatccatccattaagcgcgatgaaatccaaggttgaacgccttttcgtgaaaagataaacggcggggatcagcccgaaaataggcacaaccaatgcaacgatcaacaatacgattaaccacagtctttcaatgtttatcatgatggatcgccccctccttatagccatttattgctaagtttaaatagctttactggcacgattttaccacgaatcaactcgcagtctcttcagtagagatcagaagcgagaccaccagtatcaactcacgctagaacaacgtactgctccttttgatatggaggggatggcacaaaataagtttgtgtctggcgtaccgtcgtgctagtgctgggtagcggcagatgatggcacttaagttgaatggcgttgtcagtcatcacaaataaacaggcagcgccatcgcgaactgaaaaagttcatgatagcggtgcctgttttctggtgatgatcaaacttaacagccgaatttaaaaaccggcgatagtcgtaccgtataacttccccttctgtttctgtaacagacttagaacccagaagcttagggccaagtataacccgatagttagccaactggcttcgacgccaaaagtgccgccagtaatgaatgggctcaaaccggtattcgttgacttcaagatcatgcctgaatcagacaatccggggacagtcacaccaaacaacctgctttccgcgaagttccaagcggcgtggaaggcgccgcagaaccaaatgttgccggtgattaatcggatttctgacaagagcatgccgaaaagaaaaatgcccaagaaggctgaaacgctaaactcagaattgaagccgttcattagggtgaaaaagatcgtattcgccagacaagcggttaacaacttttgccgctttaaccagtaacccatgatgtagccgcggcagactaactcctcaaacatggattggaaaatgaagccgactaaaaacagtcctaggataggtatgccggagaaagaaaaggctaaacggacgtgaaagccttgtaggccaaaaataaatagccagtttattgcaaagagaaggaggccaaataagaatcctttggcatagcggtgaagcattcgtttctttgcgaatggtaagtagtaaggatcgcctttgtagcgaatgacgagcagaataataccaaatagactggtccaaagcgttaataaattgccagatgttgaattgaagttaaactttctatcaaacaaaaggatagcaagtattgggaatgccgtaagcatgaaccatccgaaagcaataaagaaaggcagcacctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaatacatcgccgcgaccttaggccgctctcgtatttctattaggcatgagcttcaccgttgccctgaaggtgattactgcgccattatagctcaggatcatgccgatacttgtcggcatcgttgtggtcggcactcgattttaacgcctaagttgaagcggatggtaactgagaagctaaacctaggttggtcccctgaaatggtcggttatgccgttcactgtgcgccacacacgatttaccactggatttatcaaagacaagtcgattttcagccaagccaactctttgatcacggtaaacgtcataaaagaagacaagaccttcggtcgcgctataaccaagcagtaggcacctcaattgagattcgcagtgagtcagctaatcggcgaaccgaaaaaggacatttagagatggatacagttcgcggtggtcgcgggtcaaaggctgctgttttgaccattgtcgatcgggtgacacgtttaatggcgacaactaagcttgaaaacttatcacaaaatgctgttctcaagggatttgcaagactgatggtggactttccgggtccggttcgatcagtgacggttgatcacggtaaagagttttcctgcgatcaggcgcttacaaagcgctatcggataccggtttacttttgccacgcctatcacccgaatgaacggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctagggcagaaaccttttcacttttcttatattgataatttttccgaaatatctattcataaaataaatcatatcccatcaaatagtattttaaaccgcgctggactttcattagaatacgactaaagtcattaatttgtctaggcctttttagtctggattacatttaaaaacaaagtcggtagcgctttattaacgaaagatacactagataatggattactttctctagaaagcggtatatcaaaaattgcgttgggataaggcttatgagcacttagagtgtcttaattgaaacttttttaataaaataataaatcaaacaaaaaaacacggctatcaaaagttgccttgataagtcgtgttttttcgttcaaacaagttttttaagttcatgtgcagagcttacttgctaaccataatcgcatcaagctttgcccgatacttctttgctgttgctgtgacaccggcatagtcaccggtcttggcagctgcggtgaggttgttgccggcgccgactagggtcacgccagcatcaaaccaggtttcgaggttattcagtgatacaccgccggttggcatgacggctagttgtgggaatgggccgtggagtgctttgatcatggccggaccagcaacgctgccggggaagattttgacgagatccacgccggcttcgagtgcggtttgaatttcggttggggtgaggcagcctggagtatatggaatagcatagagattacagattttggcaacgtcagcgttgaagctggggctgacgatgaatttggcgccagcaatgattgccagacgggcagttgccgggtcaagcacagtgccggccccgatgagaacatctgcacgatcaccgtacttttcactgagttggtctaatacacgatcagcatgaggtacggtgaaggtcaattcaatcccagtaatgccaccagcgatgacagcatcaactgttttaactgcttcggcagcatcgttgccgcgaacaacaacaacacagtttgtcttgattaaccgattgagataatcatatttttgcatttttttatatctccttaaatgtgttcgattaagcagaagcggatggactatgctgatcgtaattcatctaaggcacagatacttgatactaaaattcgcatcctgctgtatgaacttgttaaactgagaccacatcgtatataaggtacttatttagttgatcccagttgaaaggtcattctgaacgcaacgcaagcatcacattgtgcatgtttaacaagttttaaaagccaaaactgatataacagaacatctctccacgaaaatgatagcgtttactaaaagcgctgtcaatgtttgctagaagtctctataattttgggagcgaagcaacatctttctaaaaaaataaaagtgttatacaataaaatggataaaaaaggaagcgtgacgtacatgcagatttcgaattatcaagatgaggcctatactgccatcaagcaaatgattctcagcatgcagctgactcccggggaaaaggtcgataaatatgaattgagcacggagttaaatatcggcgtgaccccgattcgggaggcaattattcgcctgcgtcgggagggcttatttgatgtcgttccacaaagcggcacttatgtatcaaaaattaatgtggatgaaatgaatcaaggccgatttgctagagtcgaattggaaaaaactattattgctagcgctgctgagcgtatgacagcggatcaagttgacgaattagaacagcaaattgctcttcagggtgtctatgaacataatcaagactatgggcactttttcaaattagatcatgatttccatgaactcttttacattgcagatcacaaacaatttgtacggacgtgggtacaacaaatgaatctgcagtttattcgttatcgctatctacaattagaaataaatggcatgcactggcatcacattattgcagaacatcaggcaattgtggatgcagttaaggcaaaggatacaaggttggcaagtcagatggccaccgatcacttgttagcagttggtaaagatgtcaaatcagttttaaccacttatcctgattattttaaaagtcatgaatcgaacgagcctcagttaacctgactgtgttcttgctcgcggaatgattcagttaatcaatgacgtctgaaaacgtagatttttaacaatcctgttttcaggcgtttttgtgtacggtcagctaagttctgtgcatcgtgggtgctgaaacttcggcgatcaaaaataacgacaagccagctcattgacgttaatcggcgaaaacccaacgtttattttttgaggaacacaaaattgccgtgcacgattacacttaaaagaagaatcagctttttgcataatgccgagatggagcactatatgtcagccaaatcaatcttgagaacgcggtatcgaaatggctttcgtgtcaatcaagaactggggatgcctttatcatttgtattgcggattaaaagccacgctgatggcgttgccttacggtgttttcgtcagttccctaggaccaaactggtcgtggtgggggcttctttcaggcagcttattgtggctattcttttgcttcaattttgagatatacgtttatcagcatatgcaaacaggaacgctcgctgccatgcgggtacccaagggacaatggctgacgagacttggggaacagtcctgatttgtggcgttttcgtatatctgcatattttttatatagcagcgccatgacacagctgctttgctattcagaaagttgcttgtaaatggagaaggattagaaagcgaggttattatgaaagctgtctataaaggccgttcagctgacgtttgggagattagtcaaaccaatgaacgaccggcttgggttaaagccgcttttgaagagaactatctatgttggttagacaatcacctgcgcattttaatgagtggactgaacccttcgctcggtgcaaacttaaaaaccgccgcggttggtacgatcggcggcggttttgctggctataacatgtatgcgcttgggtatctaggtgattatctagatgttacgaatcatcgagttgtttcgaagaaaaagtttttgaagcagtatcagattcaagggaatgcctagctagtcattttttgtatattgataagctggcttcaagacaaaacaaaagaatctgaaattcctaaacacttggaatctcagattctttttctttcctaaaactttttttcaagcggagacctataagcaatctattgggtaattgccgctgctattattcacgcaatcggggaggccggcttttcgtttcaaatatgatacaagccaaattctggcaaatctttttttaaagcgtcaacgaagtccacacagtttcccgcctttaaagcagacaaagcagcaccaactagttgtctgccttcagcttctttccccgtcctaaatagcaatattcccttatagtaattcaatagcacgcgctctaatagaaaagattccggtaaatctttttgctcaagaacggctagcgcttttaaagcatgctggatttttccgtaccgaatcagcagtcccactgtgtttagcaagacattcatacatgtctcgtaagtattcggtagaccaatgtagatagcgcatttgtctaatagggtttgtgaaaatacggtgatagtttcaatgggaagctgggtcattgtattgccgtagaggacgagttcaaagtttccccagtcctcacactgaaataaataatccgttagtacattcaagggaacatggctaggtaggggtttcttttctacctctgcgcgaacacattcagccataatccagttcagctgatcaaaaatcaaatgcgagttttggcaacgcgcatattcggtgtcgactaagtgattaagtccttgaacattatgacttagagcaagttgcgttaattcggttgataacttgttgtcatataaaggttcaaaatggttcatgacaactgtaaattcaaagggggtcacatagatttccttaagcaaatggaagaatcttttggttgatagatctgatgtaccattctcaaattttgaaatcataccctttgagacaacatcgtctgctaaggcgctaaggcttatgcctcgcgactctctcaagtacttaaatgttgcgccaaaattttcgatgatgagcatctcctcgtttcgttttcgaaacataacttggatgtaagctgattcctgagacaacttttaagagagggtataatgaataaatcatctctcaaaaggaaggaatttttacatgccaacccgttacgacaaagaattcaaacaaaacattatcaacctatataagcaaggcgaatcagctgcccaactggccagagaatatggcattggctattcaacagttcataagtggatccagggccaggccaaaactcaatccggtaaatcgccagacgaaatcaaagtgatggaaaagcgactggcttcgctgtctgaggagaacgaaatcctaaaaaaagccctgggcttccttgcgcagaagtaaccaatatctttgattacattcaccaagaaagccatcaccaccaggtaaccaagatgtgccgaatcctcggtgtttccagagctcagtattatcgttatcgatcccccaaaccttcaaaacgccgggccgaagatgcgggcttgaaacaacggattctgcggatctttgcggaatttaagcagcgatacggtgttatgaagatccaccatgaattgaatctggaacttcaaccactgcagcttcggtgcagtccacgacggatttcccggctcatgaaggaactggatatccactccgttaccgtcaataagtggaaagcggcttcggcttccaaaaccaaggttgaacagcgtcccaacttgcttaagcaggatttctcgaccactggtttaaatcaaaaatggaccgctgatatgacctatattcaaacgaagcgtaatggctggtgttacttatcaaccatcatggacctccactcacgacggattatcggctattcgttctcaaaaaagatggatactgatttagtcttaaagacccttgaaagcgcggttaaaaatcgaaccattactggggacctgattatccatacggatttaggatcacagtataccagcgatgattacaatcaacgtttaactgagctacatatccgccactcatacagccgtaaggggtgtccgtatgataatgcgccaatggaatcctttcacgcttccctcaaaaaggaatgtgtttatccagtgccggtctttgaagattatgaaactgccgctgccgtcctttttgaatatgtgcatgctttctacaataggaagagaattcatagttcactgggctaccagacccccttacaagttgaaattgcaacacttacgagccaaatggccgcctgatttaatgctttccagggttcaaataagttattaatcgcgattaatgatttatttgagctgtggaaggtaaacgcggttctgaatgtctcttaaaatctgtctcaaatattgacttcaatccaactattgaaactcagtttagcggttatcgtatgaagtatcaataaaggtcggaggagtgcttaatcatgaaaacatatttaagacatcagcgaggccgcacagggatcaacattgtttggattattgtgaacgtccttttgtacacaggcacatcagttctcttaacttttacaacgaatgccattttttcgagggatatgaaggcactcttactgtggtccgccattaatctttcagtttggggaacttttttgattagcaattattttcaggcggtttttcaagaaaaactcacgcagcggattatgattgatgtgcgtgataccatttcgagaatgattgtcggaagttcttatgcacagtatcacaaacaaacaaccggagagtatctttctgaatatgttaatgatgttggcaacattgaaagtaacgccattaagaacttattctcgttgctgtctgatgggactaccgttgtcttcgcaaccatagcacttgctgcttatcacttactattcatcccaatgattcttttcttatcgatattgatgctgaaaattccttctcgtctaggtaagccaatgaccgtggcgacgacagaaatgtcaaacgggaatgcggcgttctcgaatcaagtgaccaatgttcttaacggatttgatgttttattaaatgcaaataaattaagcaaacttcaagaactggtaaaaacggctgccaaaagatatgcggaagtgaaagtttcatacactaaaaccaacgctcgcatttctaattcaatagcagctttgagtatcttctgtcaggtcatggtcgatattatgaccagtattttggccatccttggtgctattccacttggggcaattagttcaaccggcagtattgctgctagtatttttaattctttgtctagccttagcaacgatgccgtgcagattaaagcaacgcacccattatttgataaagtcattcagggatcttccaactcagcaagggcacgcgaaagcacccaagaaccagcgtttcagcacgctttaaaggtggttgatcttagctattcgattaacgggaacaagatacttgatcacttgaacctcacatttgaacgaggaggaaaatatgcgatcgttggtcgaagcggtgtcgggaagagtaccttactgaaaattttagatggtcaaattacggattatactggacatgtttatattgatgaccaagatttgcgaacgatgacaatgacagcgttaacaaagatttctcaatacgttgatcaaaatgtctatttattcaatgattcagtggcgaacaacacatcgctttgggcaaataagcaaaaatctgggaatagtttgcaacaggcactattaaaggcaaaggtagatttcgttaagtcaccagatcaaatgattgaagagaacggccaaaatttgtctggcggccaaaaacaacgcttagcattagcaagatttttctactcaccaaaaccaattgcatttgttgacgaaggcacatctgcgttagacgcagaaactgctagacaagttaccaagcaatttttgaatgaccctgatatgaccttgatcgaggtgagtcatcaccttgatgcgcagttgaagggggcatacgatcaagtgatcaatttaggcgcatgacttggcatgttgccagacttgatcgaataaatatttcaagaatactcggaatagattatttcggtgtcccgagtttttgttttgcaccaaaaaaaattcccgatttctcgggaatttctgttgctatttggttttcactctttaacaaggaaactaagagtgtagattattcgcttgcgacccaaccgtagtttcctaattgtttgaatgaaaagacgtcataccaaagaaccttttctgtttcgctgaatgaaaaattgtcagacagtttcttacaagtagggtctttatggcatcataacggcgcgaacatcctagacgctcttttagacgctgcttactgctgatccgcccgcaaccgccattgcacaacaaaggtcaacacagcaagtaccgcgagcacgatgaagtcgatttgactccctgtcgcgtccgcgcccaccggagagaggcggtgttgcaaggtgatgatggctgataagctggcagtgcctagtgagccagcgtattgctgaatggtgttgaacaaggcgttgatgtctgctttggctgagccggttaccatggtgctggcgtctgacatggtgttgccgaagccgaggttgaagcccatgcggaaaatgatataaaagccgacaatcaaggggatgctcagctggtgggtgaagatgccgagcaagattgcacctacgaacatggcggtatcacttgtcaggagcaggcggcgtgcgccgaaccgatcatacaaggcgccgccaatgggtgaaaccgccgcgccgatcaacgaaccgggcagtaaaatcagacctgccacagaagcattggtatgcaagacgttttcagcgaaaattggaataacgaaagcaatgccaatattgctgaattgcaaaataaagaagttaatggcgcgtgctcgaataccagcctgtttgaaaagcgaaaagttaagcagcggtgtggctgtatgatttaagtgatagctcatcccaacaatagcgacagccaaagccgcgacatagccccaaaagccagcagtcagcccagatgccgtgaattgatccagcacttcgatgagtgagaacagaccaagtccaagcagcagcaaacctagaaagtcaaaacgatcagtcgtcgtctgcgctttaacgcgaatcgtggcttcgcccaaggaccagacgagcaggataaccggcagtatcagccaaaaaatcatccgccatgaggcatagtaagtcagcaaaccgccataagttggcccaagcgcaggggccagtgaggtcacaacactggccatccccacgtaaatcccgagatggacttgcgggatcatggtcagaatcaaatgaaacatcaacggggtagaaaccccagttgccaaggcctgcaacaaacggccagcgaacaaaatcggaaaactcggcgcccagatacacaataaggttccggtcaggctgcaaagaatggcagttcgaaacaggagtcgcgtatcaaatcgtcgcaataaaaaggcggttgtactcatgaccaaggtgaccatcagcaaataacctgatgtgagccattgcaccgtcgacaatgaaacatgcagcgttttgataagtgtaggaaaggtgacgttcatggaagtctcaaccagaataccgacaaacgtcagtaatcctgctgataaaatagccaattgcgtgcgatgtgaaactggtgaagttgtcatgggagtgccttcatttctatcatttaacctgatacacatggatcatgtagcaacaggtcactgctgacgatagcagattcaaaaaaatgatgcaaaggcaaacggtttcatttgaagcaacgtaaagtctacgtatcgccgcttcacaaaaaattgcatgctaaaaaatggttctattaattgctgaaagccaccactatgatcaggatcataataactgcgaaaacgagataccagaataaccgccctgttggattattagggttaacactaatgccgatgccaaatcttttggggacgaacaagggttgctgttttgtttttgaagcgggtttatagtgtatgaagcttaagatagccaagatgaggacaagaataagaggaaccatccttgctatctttgtatctgagcgcaaggtccacacaacagaaagcagaaaaaaggcaaaaatgaaaagtatggttaatgatagtagtttgcctgatttgtttgagcgcatgatcgacatcccctagtgttatctttattaaaccactgccgagatggcttcaacttataacagcatcagattcatggcaacaaccgaatcatatagctttctaaacagatacaaaaacacctgcagtcttggaaactacaggtgttaggtctcaacggagagagtgtgcgtgcaacccgtttatttttttgaatcaggtgggacagccgctaaatgaacacgcggtttctgtgacgtgcgcggttccgccggtgttgctgaatggcttgagtttgggccatttggcgttggtgttttagggctttttggtaacgcatgatcattgtcgtcatgtgggccggggccttgcggatgattatttttgttcatctgcttgtcagtcaggctgatgacactggacatgaccagtgggagcaggaagacgaggaggatcaggccgatgatgacggccagcgcgacctgaatcaaggttgtaatgccggatgggatcatcgcggcaaaggtaccacttaggatgatggcagcggagatgacaaccgcaccgatgacgctagcggctttggcaatccgatgtgtcatggtgccgccttcgagggcattatcacggtagcgcaccatgaggaagatactgtagtcaacgccgagggcaacgagcatgatgaaggtgaagaacggtgtgttccacgtcagcatgtcgcgaccaagcacgtaagttgagaacagtttggtgaggcctaacgaggtgacgtaggccaacagcaacgttgagataatgctgataggttgaatcaaggaccgggtgacgaaaatgagggcgatgccgataccgataatcatgatcgcggcggttcgttcaaagtcgccattagccagtttttgcaggtcggcggtttgtgaagtttggccaccaaccgcgactgttgcatcggctagcggcgtgtgctttaatttggccgtcatgtcagttttaatcgcttcgatctgtttggcggcagcatctgtgctgggatcgccctttagaacaacggtcaatttggtaatcttgttgccatcagacatgtaggtcgttaacgcaggcttgaaggttttactctttaaagtggcgttagggatatagaacttcttccccagatacgacttttgcaactcggtcaggtattgtttcatgctggtgctgccgtctgcaatcgtgccgagtgctttgtctgccgaggttaagccgctttgcatggtggtgacttgttcggagattgccttcacttttgtgttcagggtttggacaccggtattgatctgatcggcaccactggcaacttgtgccgcgccactattgagggtgccattttgcccggcgagctgtgaggaccccgtgttgagttggttgacaccggaaacaagactcggtacttggctgtttaaggaaccaatcccactactcagttggtgggtgccactggtgagcgtactgatgccgctgtttaaggctgtcgtaccattgttcagcgttttgatgccatcgccaagcgaactggtaccgttcgtcagctgttgcacaccacctgaaaacttggcgatttcttctagaattgactgtgtcagttgactgccattgggaagttggttaattaaggtaacgatttgctgagcactgccggtcaagttctgaacttggctggcgagcttgttcattccgctagtcaactcaccagatttgtcgctaagttgattcatcccgctggcgagtaccgtactattcccgctaagctgatccatgcccttagctagctgggtcgaactcgtgcttaaggtgttcacccctgaactcagggctggcagctggctgcttaattggccaatcccggtgtttaacgatgcaacgccggaagtatactggccgattccgctgttaagactggaggcgccggatgaaagggtgttggtgccattagcaagggtctgcacttgttgcgtgctgccggcgacatcagcatttgtaatttgcgtattggctgagctaaggcctgcttgcacctgcttcaaccctttcacgctgtctgtcaggcccgcattaatcgtttggagttgattgtcgagatagagcgacttaatctgactgccgcctggttgtgtcacagaggcaactgtcttaacgccgttctccttttgcaggtaagttgtgaggtcatcaatcgtaccaagaaccgtttgtgtattcaacggttgcttactttgaatatagatggttgttggtgaggccataccttttgaataatgatcctgaatcagcttataaccgaccttggattgtaacgtttccggcagttcatccgcgttgttgaaattcaaggtttggttggcattcagcaaaaatggcactgcgatgatgccaatgatcccgagtgtgatgagcggtcgagcgatgcccattttggacaggccgtgccacagtcggctggtgctatgaccgttgagattcttacttggccaaaagagcttctcgcctaaagtggccatgaagaacatgttgagcgtgagcagcacgatcaagaggatcaaaacaccaatggccacgccaactgcggaacgatagaacttgaaattggcaaggccgagcacggagaagccgattagaactgagaggccagagtacaggatcgttcgcccaccaaaacgtctggcaaccccggcagctttcgttcgtggaatgccctgtgaaagggcggccttgaagtcgtcgtatagcaaaatattataatcggttccaattccgaaaaggacaaccactaggaagacttgagtaaagtttgagattggaaagttaaacttgtccgccaaattcatgatgatgttcaaggaagtcatgaaggaaatggcaacggtgagcagcgacacgagcgggacgatcggggaacggaagacaatgatgagcacaatgaaaatgaaaattgccgcaatgatttctgttttctgaatccctttttcagtgacggtcgcaaagtcgtcgttcaagacatcactgccagttacataggttttgacgttgctagttttgatttgtttttctaaattacgcgtttgcggcccgacttgcccttgggctttcacatcgaccaacgccatctgagtcgtaccgtctttggcgtctagctgtttcttagtttcggcgttgtcagatgcttgtgtgacgttgataattttgacagcaccggtactcttaaggttcttgagagtttgatgaatggcttgtttttgcgaggcagtcagttttttgtcactattgttgaaaaccagtgcataagagcgaaccttctgattattgttggctttcttttcaatgtttgcggcaatttgactctcttcgtttttcggcagcgataaggcgcctttgtctcggacgatgccggaaacatctggcatggtgattaaagtcatgatgatgacgattagccagaaaataagggccggtatgtgacgatgacgaagatttttcattgaaagatactcctttcacaggttaagccgttccagatctgattttttagctcaagggctaactgatcttgatcgggcacatggccttgaagttgttgttggacccaaacgatgtcaatcatgctgacgatgctgccgtataaaatagctaactgggtgcgaacatctgctttcacaatgacaccgtgttcctgaccttccatcagcatattgctaatcaatgtggtaacacggtcgcgagcagcacgactctctgggcgtagcgcttcattaaacacattttgttcaataaaatgcagttcagttgggtaatgttgcatggtcagtgcagcggcatcaaagaggtggctgaaagttgattcgggatcactgacgttgcaattggcagcgtcagccagtgagtcgtgaaaataatgcatgatgtcagtaaacgcggtgttaaggatatcctctttacccttaaagtgacgataaattgtgccaaccgctacattggcagctttggcgattgacggtaaattggtttccgcgtagccgcgttcggcaaacagcttgactgcttgggcgatgattgggtctggggtggcgatgggtttcattttttctcctccggaatgaacgttcattcgcatatattagaagttgtgaatattcttgtcaagagcatattgaaaattaacagggagcgtctacgatgttgtaactggcacaatggctataaaagaagcaatacaaaggtggcatatggctatcattttcaaaaaaaaaccaccatcaaaatcttgatggtggaaggagaggtaactaggttaatttgtacaacagactgtcacgatgttcttaacgagactcactttgaataacggctcggttttacccgtgaagttttgactttctgatccagattttgttccggtaagctggcaggttcctcgtgcactggtgtggcatggtgtggcgtgatggccgcctgccaagaatcaggggttggagctgccagcggttggacctgactggtcgagatgggaacggcagacgtcgacggtttggccggttgcggattcccggctgttaagaggctggcggcgatggccaaaaaagtgatactcataagtaagactcccttcgatcatttgactgctttcataacagccaatagtaaaagcttaccgaagggatgagacggattcgtaccgactcagtggcggttttgttgaaaaaggacgatgaaaacatggctttttgctaaaggaacctttaaggaccgtaaaaaaagacgaccagcaatggccgtctttagggttaaataaggttcatgacgattttaagactctgctttgccttttggttccaagcggcgctccaagaatcccagtaccaaatcagagatgatcgccattaacgcggttggcaatgcgccggcaaggatgatggcgccgccgttggttgcgttggtgccgcgaacaatgatgtcgcccagaccaccggcaccgacgaaggcaccaatggcggtgatcccaatagccacgaccagcgcgttgcgaatgccggccataatgacagacatgctcaacggaatttcaaccatgtacagcgattgccaacgagtcatgcccatacccttagccgcatccatcaagttcttgtcgacattttgcatgcctgtgtaagtattcttgatgatcggcagcagcgagtagaggaaaacagtcacgatgacggtattcacacccagcccgaggccaagcatgatgatcgataacatcgccagactaggaattgtctgaatgacgttagcgatgccaatcaccgtgctacttaatgtccggtgccgcgcaattgccagcccgatcggaatcccgatgatggcggcgattaacaccccataaattgagatcagaaaatggcgagcaaactgactcagcacatacgagccattattggcaagatagtaccagaattgctgccaggtatccatgttggccattagtcgtcacttcctttgaaatagttgtgtttggcaagaaacttttgcgcgaccacgttcggttcaagcagttgatcatcgacttgataattcagctcttgcatcgtcttcaggttgattttgccatctaaccgatgtaacagcggcttgagtttcgggtattttttcaaaaagctgttgttgacgacgagcgaacattgataaggtgggaagaactttttgtcatccttcagcactttcaagttgtaactgcgaatgcggccgtctgttgagtaacctaagaccgtctgcatcttgttggcttcgaccgcatcgtaaaccagtccgatctgcatcgggtagactcgtttgaaatcgaacccatacattttggtgaagtcgctataaccgtcgcctttgcggttcatccaactggaatctacacccgcgttgtaacgcgaagcgactttcttcaaatcggaaatggtgctcaaaccgtcctttttggcttcctgttgggtcaccatgaaagcataagtgtcggaaaaaccataagacgggtaccaagtctggtcgtaacgctttttgaattcgcgcttaacaatcgccgtagcttcggcaggatccttgacgggattcatgcctaaggtaccggtaatgtcggtcccagtgtaacgggtagcactaatgtcagcatcgttacgaatcatcgcttgatgcaccacggtaccagaacccaggttgttgaccaaagtcgttttgtagccgagttcatgattaatgagttcggcaatgatatttgccatgatctgcgattcagtactggtttgcgaagcgatccgcacagtaccgtcattaccagagccgcccagtccgggaaagccgcagccgcctaatagcaagacggggatgaggaacagcgataggagcatttttctgaatgtcttcatctcgccacctcctaggcctgttcgcttactggggtcagccgatgttctagccggcccaacagccaatcaaccaagagtgccaagatggtaactggaatcgtcccgccaatgattaagtccggctggaagaggttcaagccgttgaaaatgagatctccaaggccgccagcaccgatgtacgatgcgagggttgcccaagcgatgacataaatggcggataggcgcacaccggccatgatgaccggcatcgccagcggcacttcgacttgtcgaattgattgcaaggccgtcatgcccatgcctttagcagcatcaatcaaaaccggatcgacatcttccatgccaatataagtattacgcagaatcggtagcagcgagtagatgaacagcgccacaatggccggcaacttgccgatcccaaaaattggaatcattaaggccaacaacgccagcgatggcaccgtttgtaacatgctggctagaccgatgacaactttcgccgttttaggaaaacgtgtcagcacaatgcccagcggcacggctaccagcacgccaagacccagtgcgatggcggaaatgtagagctgctcccaagtcttggtgattagctcgctgccatgtgcgtttagaaatgcgaacatggtcacacctccttaggcgtgtcactgttagcaggcgcttccgaagcagcagttgctgaagcggtattttcggtatcgctatcagcttggtcactgtcgttatcgtcagatttgtcatcgttgtcgccccagatagtgtcgtaaacaacatcgaccaaggctgctcgggtgacaatgccgacaagtttcttatccgcatcaacaacagggacgtatttaagcccgcgtttgagaatgcgatcagcggtatcacgcaaaagtgagtctttattcacgtagaaaatactggttttaatgatatcgccaacactagtggcactttgataacgcgtctcaagggattcaagatcaatgaaacctttaagatgattctcgtcatctgtgaccagcagcgtatcaacgcggcgtttgcgcatcagcagaatcgcttcggccagtgatttgcctggggtaattgcagctgggtttttaagcatgatttgttcaacggtggtgacatcggcccgcgcttgaacaagtcggtcttgcccgacgagattttcgacgaatttgttggccggatgggttaagagttctgtcggtgtcgagttttgaataatatgcccatgatccatgaccacgattttagttgcgagtttcaaagcttcgtccatgtcatgggtcacaaaaaccacggttttaccgagtttttcctgcaagttcttaatcagttcctgcaaagcttcacgggtgatgggatccaaggcgccatatggttcgtccatcagaatcagatcctgattggctgctagcgcacggataactccgatacgctgttgttggccgccagaaagttcggaaggatagcgatcaagatagtcttctggaagttcaactaaatcgagcagttccttggctttttcccggcgtttttcttcgggccactttaacagctttggcacgatggtgatattttcatagatcgtcatgtgtggcatgaggccgatattctggatgacataaccgatttgccgacgtagtttaacggcatcgattttatgaatgtctttgccgttaaacaggatctggccgccgctgggctccagcattcggttgatcatccgcatggtcgttgtcttcccggaaccagacgtcccgatgagacagacaaaatcccccttatggatctcaaggttgatatgttcgaccgcgacatttccgcctcgataaactttctcaacgtccttaaataggaccattggttgttcttctggcatctgacgcgtcctcctttatttgaatacttctatattaccacatggggttaatcagattttaatatatttgagaacaggtgtttgcagaaacgcctttgttagctatttcatttaaagtgatcagagagttcggtggaactaaaaaatctgcttctcgaaaagtgtgggccatcattccctcgtaggacttgtgattcattaaatgacgaataatcgtaggaaggtgctgggctaaaattctcttgccgtgccaaactccgcaatctccggccagctggggctggaacgctgtgacggcgcttcgagaccgcgggctttgcgggctcgaagtcgcctaacaacatcagctccacagcccgtcgctgtgttgtttgcacggctgagccccatctggcctacgattgctccgccttggcactggtatttttaaaaattccaatagactacccaaatgaaaagacaaacaatttccgcacttaatagaattcctgcagaaattgtttgtcctttcatttgatagctgtgaattatggcccaaccgcgttcccgtaagcaaccggcgttcccaagagactgacttcaagtgtatctgcgacggaagtgtctttttactttcccgagattcacaatcgcagcatgactagtattgtcacgataatgttataagtcatgtgtgatacaatgcttgtttttattgttccagaagctcgattgagaagactaaaaccaattgcagcaagaagtaggcacaatgaagcaacaatctccaatccgtggagaaaaacaaaaatgagcgaggttatgagaactgatggccaatagccaaaaatacttgccaaataatcttggataacgcctctaaatccgagttcctcacatatcggggttaagaaacacagagagataatcattggccagcgcgatgggccagttaatacttttgcagttgacgactgcaacacattgtcagttggagccgggagaaatggcagattattgagtgttattgttaaaacaacaatgaaaatggtccaaatgaccgctatataaaaataacgtgctttgagtggctgattaagttgttgcgttgaagaaggctttatatgacgatcaatgaatagcagtgatggtattgagatactggccgcaataacaataaatagccagtttaataagacaccttcaaaaaagcagtcaactagggagactccagaggcaaggaataagaatggtataaatagaatgatcccgataaccagctgttttagtttattcaaacatttctccaatttgtagaagcttaagaaacaggtagcatcatgcgctgttgataatcttgtcgctactgatgcttacgggcatgaagctttggattagacgcatacttttcatgcaaacatcttattaatacatagattgccacgcaggttacgatagcgcttaaccccttgagcacattcccgaatatcatattgttcgtccagagagcttcgatatatctgaagatgctacggttaaagagcactatcagcaatgcaccccaaacttttttatcgcgattcattttagtatcatctcccaattaacgcatcatcatggctgaggattggtcatactagaagaccactactcaaatatctgttatgtatacgaatgaaatcttacaggaaattcgataagacagcaattaagcccccaacaaccaagataccttcaagactaagcaaattaattgtaactgaaactgatgatgcttcatcagtttaaaaataaacgtcgtgttttcatcttttttcgtcataaacatgtcagttccagaataatcgtgtggcaaatccctaaagttgatcaccgtcaaggcagctttcttcatacctcggtacactggtctcaaatggagggattagcgatgcattttattcagacgcataaacaagaagcgatgattgctggcggtgtgctgacagcaggcggtctgatttttagtcaggcatgggtgctagtgttggcgagtttggtggcgggcttgccgattgcgatcaatgcattggcggcgctgcggtataagcagattagtattgagttgctggtgacgattgccctggttggcgcggtgttgattggtgagccggttgaaagtgctgtggtcagttttctatttttattcggtgactggttagagcagcgcagtttggcgaagacgagttcggcgattcaaggcttggcggctgcggcaccgaaaaccgcgcggcgactggatggcaccatgattccggttggtgacttggcagttggtgatcaagtccgtgtactggccggcgaaacggtaccagctgatggcaaagtgatcagtgggcaggcgaatgttgttgaagccgcgatcactggtgagccggatgcaaaaagcaagcaggccggcgcaacggtttattccggcacgcaggtgagtgatggcacggtggctattgaagttgagaaaaccggctacaacacggtttatcaacagatcattgatttgattgaggatgcgcaggacgcacagtcaccagtcgccacttttatccaaaagtttgcgcggtggtatacgccgctggtattgatcattgctttgctcgttggtttgatcagccaaaatgtccgactagccattacgattttggtattaggctgccctggtgcattggtgattggcgcccctgtcagcaatgttgtcggcttaggctttggcgcgaagcacggcattttgatcaaaggcgggggtgtggccaccaaattggatcagattgacacggttatgtttgataaaaccggcaccttaacccaaggcaaaatcagcgttgcaacggcccaatattgggcgaacaatgacgcgaaagttgctgagctggtggcggcggttgagcaagcaacagcgcatccgttggggcaggcattggtcgcctacctaaagccgcaaacaacaccggctgtgaccgacgtgaaagtcacgcggggaattggcgtgcaggcgcaagtggctgaccataccgttagcattgggaatcaaaagagtctgacgcagccgctgactaccgctcagcaagctgctattcaaaacgtgattaaaagcggtgcttcgttggtcgtggcgacaattgacggcaaacttgctgcagtttacggcttacgcgatcagttgcggaccgatacgccagccatgttggcaaagcttcaagataacggtaaaaagacggttgtgctttcaggcgactcgcaggcggcggttgaacacatgatggcggatttgccactgagccagacccacggcggcttattgccagtcgacaaggtcacggcgatcaaggcagcgcaagcgcatggtgaaaaggtgatgtttgtcggtgacgggatcaacgacgggcctgcactggcgcaagcagatgttggggtagccatgggctcagggatggatgtggccattgatactgctgatgtcattttaaccagcagtcgcctgacgaatctcggcgttcttttcgatctggctaaacggatggacaataatatcaaacagaatcttgtcattgcgatcggaactgttgccttattgttaagcggcttgctcattgggttagttgatatggccagcgggatgctgttccacgaaatttcgattctgttggtcatcgcgaatgccttacggttacggcacaccccccgaaagttacaaaacttgacgacgatcaaggacgccgcagcacaaaccgttaataatgaaggtaaataaacaagaaaggatttttaacatgacaaaattagtttatcaattagatggtttaacctgcccaagttgcttgcagaaaattgaaggcgcattaggccagcaagccggtgtcaaaactgtgaaagccttgtttaacagtagcaaagtcaaggctcaaattgatccaagcgtgaccaacgccgatgctttgaaaaagacgatcacggacttgggttataccgttgtgaacgtgcgcagtcaagaagcatagagcgagaactggcgcggttagaaaccggagcataagcagccttgggtgtggtggctgggccaattacccccaaggtccttatggaggaggtttcgatgctatagaacgcttttaaaaataaacaagcgcggttaagaggagaagaacatgagtgtaacgacaggaatgaaaagtattaccgctgatcaagttaaagaacaacaagcagctgctgctaaacaggctgaccatgaccatcatgtgccaactgctggcgcgatgagtggccacgtgttggcgaacttgcaggtgctgatccgcaagctgacgcagtttcgggtgaccttacgaggtgtggccagtgaaatcgatcggcaactgttagatcagctaatgcaacaagcacaagaccattttgacgaccttgtggctgatttagctgcccaaggcgaagattttccgacaacgacagcggagttcggtgaatacacgatgctcaaggaagacccggcgtttcgtttttggacgaatgatatgaaattggacgccgttgtcaatgatatcgatacctgccagttgtttgtcagtcgggcgattccgcttgccaacaaggagaacaaggctgtattggcagcagatatgttacaattgcagcgctggcatgaacaaagcattctgcgcttgcaaactcgacttggccgccaagtgacggcggggcgggcattgcttgacgaggatgaagatgacgactgatcaagcttgttgacagagcgtgagcaggcgcgtttaggaggtggcaacatgacgcacagttgtacggcggtagtgccgttattcaaaaatttaaacgatgaggcgcgtgccgccattgacgcgttgacgcacgaacgccaggttgaaaaaggaactgttttgatcagccctgatacggccgcccatttgttggtggttgcgcacggcaaactcaaaacttaccagttggccaccaatggcaaggaacagctactacgggttgatggtgttggtgattatgaaggtgaagccggcttactcaatatcgctaatccgaatgtctataccgaaaccctgacggcggcaactgtctgcaccatcagtgccactgactttcaacaattgcttctcaagcagccgcaaatcagtctccaactcctgactgaaaacgcccgtaaaatgcaggctctggaaaaacaggccggctatttgggtaacgattcgatcaacgttcggctcacccactacctactggacttgcgtaccgcggcgggccaggacaccgtcacagttccgatggcatggacacaattggccgattatctcggaacaacgccggaaacggtctcgcgcactttgaaacgactcgccgaggaaaaactcattgaacgttcaggtaagcaggtaagaattctgaatgccgaggatatggaagattttgcttggtgaggttgccgagtgatgttttttaaatacaaaaagccacgaatcatgcaatctaaactaattgcacgattcgtggctttttctttgttttgcaagaagcgacatataaataaatcgtcactgaacaaaatttaatcaaaacaatttttcgttttttaagaaagccagcaaacgcaaccttcaatcaaagaatacttattgaccacatacatttaagtccatagacagaccgtaggcttagagagaggactaattaccctgttttcttcgtctagcggattggatggcacacacccctcaacattcttgagacgcggaggtgagggccatgccaaaaccaggagacgaaaggggttcgccgcgctggatgtggcgtcgattatcatcgcgctaagcatactggttaccagtatcgccaaagcgtatgcgataatcaaaaaagctaaccgcaaggattaacttttacccaaatagtcatctgaaccgcgttgaggtcatcgggccgccacccgatggcctcttttcaacgacttaattatacacaagatgctaacaagacgtcaacatacttactttaatgaagttatatgtgaacaatgctgatcttggtcacacgattatttcaccgaaatttgctttttagcatcaacggccactcggatctgcttagtaaacttttcaatcgcagccggtgcctgttgtttttccttcgcgacaagatcaacgatggcgctgccgatgatgacaccatcggcgatgcctgccattgtttgtgcttgttcaggcgtgtgaatgccgaaaccgatagcggttggaacgttggtatactgcttaatttctgcgactaatgcctttaagccagcaaagaattcatcgcgttcgccagtaatgcccattgatgaaacgacatagataaatcctgaggcacttttggcaattttctcaattcgatgaccggaagttggcgtgattaacggaataatatcgataccgtatttttcggcaattggcacaatttcatcgcgactttcatacggcagatctgggatcaccaagccggcgacatttaaatccgcacagcgttttaagaaggcttcgtagccgtatttgaagacaatgttcaagtaagtcaggaagacgattggcaccgtggtttctttgcgggcggcttcaacaatgtcaaagaccgttttggtgcgaacgttggccgcgaacgctcttaggtcggcggcttgaatcacgggaccatcagcgactggatcggaaaaaggaatgcctaactccacaatgtcggcgccacctttggcaagtgcgaccacgtttttgacggtggtttcaaaatcgggatcatcggcgacgatgaaggggataaagaccttatgatttttaaaaacatctgctaacttactcatcaacatcgactcctttgtatttggcaatgcttgcgacgtccttatcgccacgtccggacagggtgcagataatgatttgatcttttgtcatcttcggggcaatcttttcaacgtaggcgatggcgtgacagctttcaatcgcggcaataatgccttcttgtttcgcaatgtaggtaaaggcttcaactgcttcgtcgtcggtaatgccaacgtattgcgcccggccttcctgagcgagagcggcatgctcggggccaacgccggggtaatcaaggccggcagaaatggaatataccggatcaatctggccatcttcattttgcatgaataaggacttcatgccgtggaaaatgccaacggagccgcgttcgatagttgcggcggttctgtcggtatcaacgcctttaccggctgcttcaacgccgactaattgaacagaaggatcatcaatataagcagcaaaacttccaatggcgttactgccaccacctacacaggcaacgaccatgtctggcagccgagcttctttggcctgaagttgctgtttcgattccgttgaaatgacactttgaaaatgtttcaccatttcggggaacggcgcagggccgactgcagaacctaacacgtagaaagtgtcatcactgcgactcgcccattcttgcagtgtggcgttaaccgcgtcttttaaaaccattgatccgcttgtgactggatgaacctttgcgccgagaagttccatgcgataaacgtttaacttttgacggtcagtgtcttctttacccatgaaaatttcacagtccatccccatgagtgcggcaatggtggcggtagcgacaccatgttgacccgcgccggtttcggcaatcaaccgctttttgcctaaatatttggcaagcaaggcctgaccgatgacattattgatcttatgggcaccggtatgatttagatcttcccgttttaagtaaatcttggcgccaccaaggtcttcagtcatgttcttggcataataaagcagggatggccgattggcgtaattaaccaataaatcatttaattctgctttaaaagcaggatcatcttttaagtcattaaaagccttagtgactttttcaagctcggtcatgagggtttcaggaatatactggccgccaaagtcttttccataacgaccggcgcgtgttggctgttgggttgtttcatttagtgtcttcatagatggcttcctcttttgcttgttgaatgaattgggtgattttatcagcatctttatggccgttggtttcaaccccgctggagacgtcgaccatcgtgggctgaacgagttgaaccgcttggcgcacattcagtggcgttagaccgccagccaaaatgaggggtcggctgatatgggggatagcttttaagttaagtagttgcccgctgcctttgccgctatcgaccattaaataatcagccattgaggttagatcaatggcctggcgttcaaagacctggatcacttttaaaccggcttgttgaagttgcgtgatttcggctggggtgcttttcccatgaagctgtgcaacatcaatggcacctgcttgatagatagccagaatttcggcgactggctcgttgacgaaaacaccaacggtcttgatcttggaatgaagcaactggtttaaggccaacgcttgctcaagtgatacttgatgccgcccgggagcaaagacaaagccggcaaagtcagccccagcagtattgactgccaaaatatcttccgaatgcatgagaccacagattttaacgagtaccattttgggaacctccttaaccgcgccagttcacactctttcttaaacgcgatcactgccgcagaaacctccacataaggaccttggtcgcaatgaccaaaatgcggtcatcacgtccaaggccgcttatgctccggtttctaaccgcgccagttcacgctctttccttgaacgccgctattaattgttttttctggttggatcgcatgagtgtttcaccgatgagaatggcattgaagccagctgctgccagtttttcaacgtcttcctgcgtcttaatgccgctttccgcaacgacggggatgttgtcgggcaccatggctcttaatttcaaactattgttgaaatcaactcgaaagtctttgagattccggttgttaatgccgattatctttgcacctgactgtagtgcccgtgtgacctcagcggctgtataggcctcgacaattgcgtgcataccgagtttttcagccagttggcgataatcgcgcaattgctgatcggttaggatcgcaacaatcagtaaaataatgacagccccgtttgccttagcctcgtagatcatataaggatcaatcgtaaaatcttttcgaagcgttggcaccgacacttgttggctgatctcctttagataatgaaggtggccgttgaaataatcgggttcggtcaaaaccgagatagcatcggcaccagcttgatcgtacgctttggcgatcgccaagtagggaaaatctgtgacaattgtcccctttgatggcgaggcctttttgacctcagcgatcacgtgtaggccaggttgttttaagcgtgttagaaaatccggcttgtgattgcgcggcattttggccacggtttgttttaaatcagcaagtgactgttggcgttggtgacgcgctaaacgaattttggtcacagccaccagatcatctaagatcatgccaccacgtccttacgcttgtcggagaaagccagtaggcgattgagttcttcaaaggctttgccatcgtcgatcgttttagcggctaaatcaatccctgcttgaatggataatgctggatgagccacgtgaagcgctgcaccggcattcaacaacacgatgtcgcgttgcggtccgtgatcgccggctaaaatacgccgggtaatgtcggcgttggcctcgggtgtgccgccaaccagatcagcccgctgacgacgtttcaagccaaattgctcaggtgtcactgtgtatttcgttaagtgatcatcctgcaattcaaccaccgcggtttcatcggcggtggtcatctcatcaagaccatcgcggccgtgaacgaccatcgcgttggtgacgccgagctttttcaagacattggctaatggctcaagcaaggtttcatcgtaaaccccaagtagttggtgagttgggtgtgccggatttgccagtggcccgaggatgttgaaaatggtgcggaagccaagttgctttctaacaggggcaacgtacttcattgatttgtgatattcctgtgcgaatagaaaggccaaattgttttcttgcaggctttcataactgacagcgggtgtttcattgatgtccaaccctaaagcctcaagaacatcggcggccccgcttttcgatgaagcggcgcgattaccatgtttagccacttgggtaccagttgccgcgacgacaatcgcgctggttgtggaaatgttgaacgtgttagcatgatcaccaccagtaccaacaatttcaagcacatccttggtttcgggaaaagcaagcgcgtggcttctcatagaagcagctgcaccggcgatttcatcaatcgttggattcttggcggttaacgcggtcagtaagctggcagtttgcacctcagatgcttcaccgttcatgatttcatccaaaacggcttcgctttcttcaaacgttaggttttcgtggttcacgactttttcaatggcttgtttaatcatgatgaatgcctccaaattgtgttttgacagggattgttgtgagttttaagtgattgaaagctatgataaaaatcgccatcgtttaatctcgtttgtctgattcatacctaagacctccttcgataacgcgttcgctggcgcagaaacctgcgtgtaaggacctgaatcgcaatggtcaaagaccgaccatcacgcttcaggccgcttacactccggttcctaagcgcgccggctcacgctcacaaaaaaatccgcccataactttgaaaagttaaggacggatttttccgcggtgccaccttagttcgattaattcgagacttcaacaaataatagcatctgatttgtctaaaaatccccatttaatcacgcttagcgagagaccaacatctctccgacaactgacgtatgcctttacgtttctccgtacttgaagtttttcgggagaaccctccgtggtccatttaatcatctgcgttcgattgcactctcagcaccggcaactctctttgcgcgcacaatgatcttgatctccacatcatcggtttgttcatggacgaattattaatgattggtttgaatattagaggcttgccggaagaatgtcaacaattttaatgtgtgtgtttgtaaaaaaatgaaagagcatgaacagcagacaactaaaatgacacgtgatttaaagcggtgagatatttctctagatacttggtttgatctttaggatgatactgtgtgataaaacgaggatgttctaacggcacgattgtttcaagaataatagaagcttagactcagtaacaatagcagcagcacctagacgtggagaaggagaaatgatgatgaacaaaaagttgagcgtggcagtgttggtgctcggatgtttgagcttactggctgcttgtcaaccgagtaacgttgtgagcaaggttaagcagcatacagtgaccgttttaaaccaaaaggatcaagtgtggcgcgaaactgaggcggtttctgccacggtaacgagtcaggggagtttgaaaaacgagcaagtaaaaccggacaacaagttgtcacctgctatcacgaatgccggtaaattttacagtgtcgctactttcaaacagagcgattatgccacgatcaaaaaggctattcagaaaaatgaagcacagcctaagacactccgcttcgtcacagtgaagcaagtgaatgcgacgcttaaagcgatgggggcaaccaaacagattaaagcattaacggatttggtctatacacaacaagcggatggtcacacttttcctagtaatgatggctatctcattgaaggcgatcatttgtatgaagtgatcatggcttacacgacagggggtaatgctagtaccgtcaatcgcggcaatgtttactcgcggaaaatcaagtacgggacaactaagcaactgactttcaatgaagtggccggcacttggcaaagtactgcaggcgatcaagctaccgtgcgagatgatcaattggtgaccattcagaacaagtcgtatgttcgcggcaaagttgaaaatctaagtcacttgcaaggagaaaagttatatcgaaacacggcgtactccctgcgacagactcaactggtcaagcaaaatgctaagttgacccaggaatcattggtggcgggcgacttgtatgacaatatgtatctattcctatcaaagacaaagatggcacgtgtgaatactagcggcgtgaccatttttacgaaaaaggcagatcaaagccagattcctgctcaagtctttgaggtttttcggttattagaccagcgccatacagacgaagtcgcagcttatttattaccgcacgggactgacacttattctgtggcactgactcgtagcatcaactatgcaacggtaaattatgaaggcggcgcaacgggagcagaatcagtgtcgattcaggatggcaaaattagtgttggaccagacttaaatcacaattgagcatgactcacaactttactcgccccagtcaaaaataaaaattggtccatactcaaaaaacatcagcaggcagtggttggggcaactgcattgctgatgttttttgatttctcctaggcgatgagaaatagtcaaagggaattattcatgccaagccgccgatccgtccaaaaagctactggtgatagacataggacaatcaaagcgccaatcaggtacgtgtgactaaaagcctgagctaagcgggtgtttttgcgttgggtaatgtcgtgaaaagcggtttgcagggtttgtttctgggcgacttgtttgatgccggtcaaaaaggcagcttgtccttgcgccatggtcgcagcacccgcgcttagttgcacgatactggtggcaagcggtgaacgggtttgttgagccgcttttgccagtgcttccgagccgtttgccaacttgttactgccttgttgtaagcctgcactggcatcatacaacttgcgaagatcactgccagcagcgggctttggtagattagttttaactttggctgcttctgagatggtttgcctcatctttttctgttggtgctttgtcggggttgatgatccggcaaagaccgcagcgagctgctggtgagcaactgttttgacatgtggcgacaaggtttttgccgatatgatttggtcgccagcatgatgaatctgcgtttttgctgtgtcggtattggtatccaatacggtgaccagaatcgcaatacctaaacaggtaccaatttgccgggccgcgttgacaatcccggaaccaatcccacttttatttttgggtagatagcggaccgaggcgaccattgagactgaggcgaagccaaaaccgaaaccgttaatgacgagcagcaccacgattaaggcggttgcggtttctgttttgatgagcgacagcaggaaaaggctggcagccatgagcagcataccagctaaggtaaccggaatagcgccggttttgtcgagtagtttggtgccaagtggcatggcaatcatgatcgttagggaaactggaatgatgatgagtgcggcatgcaaaggactatcgcctaatacattttggaggaaatagttcagaatcagactcggtgctactaacgcaaagccggtcatgaagtaaacaatgctggaggcactcaacgttttttcacggaaaagatctagctccaacagcgggttcttcacgcgcttttcggtggcgatgaacgcaatgagggcgaggacaccgccgattaaactggtcagaatcagcaaggatgtccagccgtattggcgaccttccaacaggccaaatgtgacaccgccaagcgcggccgttagaaagacaagccccggaaaatcgataccgccagcgagggattcatcataggattcttttgcgcaaacggcaatgagcacgaaggcaaggatggctaaaggaacattgatgccgaaaatccagcgccaagaagcgacttgcagaatgataccaccaattggcgggccgccagccgctgctagtgccgtgactgctccgacaacggaagcaacgcggttgattttctctttaccgaagacctcaattcccataggcaagacaattggggtgatgatcgcgccaccgagaccttggaagaaacggaaggtgatgagcatggacagagaagtcgccgtcatacaagcagcggagaagccgccaaagagaaggagaccaagtaacatgattttcttgcggtcaaaccggtcagcaattttcgaagcggtaatcatgaagaccgacatggctaaggtataaatcgtcatgacccaactcgtattagcaagcgagccattgagatccgtcatgatttttggaatcgcaatattgacgatcgtggtgtcgagggttcccatgaacatcgcgatcgtcaggccaatgaaacaaagtgctttggtaaaacgcgtcatagcatccagtcctttcatctgatacgtttgtgtctatgtgacacatgtgtgactttcgagagcactttgagtatactggggcttaggagaagcggcaataggttgcagacaagtgctacaaattggcagtatttgtgtcagataaggggatgcgagcgatgaacggtaaacaacgaatggcggcgcagtctagacagtggttggttgatgccttgattgagttgatgcaacgcgaagatgtggctgatatctcaatcacggaaatcgtgcagacagcagatctttcacgaaagactttttatcgggcatttaaaacaaaagatgacttaatcgattatctctgtgcccaattgacggatggctattttgaaagtttgcaaaaagccacccgcgatcaggaaccgattagttttgaaacaaccatggcaaacttcttcaacttctggtggcagcaaaaagaccttgttcgcttattgattcgacaaggtctgtttgatcgtttgaacggggtttggctgcaagacgcggttgctcactaccgcgcgtttcctgcgccttggcatgtcgccggtaccgatcaggaagtgaactacatcatggcctttgccctcggtggcttcacgaatattctacgcgtctggctggcgcaggatgagccagaattgccagaacaggtgcaaaaaggggcgctggctggttttggacaattggcgcggagcattggtgggacgaattaagtacttaaccaatagtttaatagctgaactaattgcgtataagtctttgtggacagtatgatgggcatacaaattaagctaatgtgaaaaacacacaaagttgaaggagtccaacaaactcatgaaagctctcatttgcctcattctaaatgcacttccgtatgccggtatcgcactgttgttagattaccagtatatttctgacggccctgtattgatatactttttgttgcaattaagcatctctctatcaatatgcttaattatgagggaggagacaaagaagatgtggcgcatactgtttttctcccagtttttatcattgcttctaaatctactgacgttatatgctggcaacctgccattctcaacctactttaaaccatttactgtttatggctggtctgtattgacccaagtgtttgggttactgttgcaggcgataacagccgggcttttcatatgggtgaaaagggttattaaagataaaaattaattggtaacgttaagtcagagttgtcaaacgtgaaaccattttgaatggccttttctcgaggaacatcaatcaaaaagttgatagttttctcttcattcgacttgatcatcggaagcggtgactgcggctgtagcgcgacttgttgattgtctgaataggcagtgaaatttgttggggaaaacgtcagcggaatggcgtaatgatagttatggaaagtgagcgaaatgccggtcttattttgaggtgtgttaggtagatacttggtttggatcgtaaatagcagttggttgttagcaccgtaataagttatcttgctaccaatagcaaccggttttcgataaactgatcggcgcggaatttcgtatgattcaagtagaggaatgatctttttgctagtatggcggtgacgtgaagttttcaaaatcagttttgttgaggtggcccgcagtcggtttaagcttaccgtgccttttttaaccgtcccagcagccaattgattgttattcaaatctttcaatgtatagctggtatttggctgggcatggaagctaagtttaaggccgttattgccaatcgttacctttacttttttcacgatagacggtttcgtttcatccgtattagtcttggataaggctgattgtcgcggcactaaaaagaagacggttaaaaagctaattagcagaactaacacgcgttttttcacgacggaggcctcctcgatttggatatgaaatgacgatggatcaatgggtgacgagtgtagcaattgcttataattaactatatcataagctgtaggaaataatgctgtccccagcgaaaagaggccatggtacgatgaaggaactgattgtttagtgatgtttcttacggctagtcaaacttaaattaagaggatttcttagaagagagacgacgacaatgaaaaagccaatggcaaacgcttacgtttttaacttgatagcgacagtaacatctgctgttttttcgatttttttgatcacacaaaactttccaaatgtctttcaatttggagtctcgtataaaattgatgcttccaatacagcgcttgttaagcaactacaaatgatgtatacaccagcaattgtagttgctttgattgctgccgttttggtattcacactggtgatcacaatgctggtgctagttaagaaaagaaacgtcagcgctttgggcagtatcattgcactgggtatcacgcttattcaaataggatatcttagcggcttgttttggttggttcagtcggtgcagtcggcattttcgctagccggtgacatcctgcaaaatccttatattggaccgttacttcagttgattaatttactgcttcttgggggatcatggatagccaatatggttgtggcgattgattatcggagaaacgggattaaggaaagccggtattaaagatgcaaggcgcctttcatcgaaacgagcgattttatcctgtagtaactatgcagaagctgctgcattggcggatgcttttagtcatactttcgcgtttttgaaaagtccttcaattgccataccaaatttgaaatgggttgcttatcaagtggcattaggaacacttgtcattggattgacaatttttgttgccactaatcctgaaagtgtaccggtagttattccaacgatggcgaagttattgcctgctacattctaatactgacagtttggagaacacataatggactatataatctatgctacttttgtggtcatatttatctctatggggacagtggtaatactctactcaagccatataagagcaaaagcttgggctgctcttagcttggattcaaaaaagaacgttgctgaggctgctgttacgtatgcagctttaaccaatataaaaagaaaagcaaagatgataaagctctgtcgttatattgcggttgcaacgttattgctgagttgggcctattttgtatcgaatagtacttccaacggcattgggtcagatgaattgcgtaactggattctctttttaggtaatacaatctttacgatagcgttgatagtagaggtttctctgaatgcatatgtgactaaggtagctaagaatacagttccatctgttctgagtggtaagcaagtaaagatgatatggagattatatgtaatgagtcgcattttctttgtaataggctgttcagcaggctctttgttaacgcattccgttttctcttaattactattaagaaagtgatgaagaggctgggtcataattccagtctcaaatcaaaagagcttgggacataattctcagtcgacaattaaaaacgagcaattttccaacggaaaattgctcgtttttgccttcgcgtggatgacttattgccattttaaagaccgtagtgccaaggcggagcaatcgtaggccagatggggctcagccgtgcaaacaacacagcgacggtccttggagctgatgttgttaggcgacttcgagaccggtttttgggctcgaagcgccgtcacagcgttccagccccgtctggccggagattgcggagtttggcacggcaagaaagtgttagcatagcaccttcctacgactattggaatttaatgaatcacaagtccgacgagagaattatggctcaaccttttcgtttataaaaaattctccaacccaacaaccaattcatcagccgtttgcaccttactaatcgcgactgcgacgccttgcatgaagctttggcggtcgaaggagtcttggcggatggtgagggcttcaccgggaccgccgaagaggacttgttcgtgggcaatgtagccgggtaggcgaacggcgtggatcgggacgtcatcgacacgttggccgcgggcgtcattgtcgatggttggcaatggcttttgggtacgtccggcggcgattttgtgggcggtggcgatggcggtgccagaaggggcatcggctttgtcctgatgatgcatttcgatgatctcggcatcagggaagtaggcagcagctgcttgtgcgaacttcatcaaaagaactgctgagagcccgaagttcggggcgatcaagccaccgaggtgtttggcattggcaagtttgatcagtcgttcctgattagcagggtccatgccgctggtgccgacgattggatggatgccggcattgatggcagcttcaatgttggcagcaacggcgctgggattggtgaaatcgacccagacatctgccacgtgtgcatgaagctggtcataggtgttgagtacttgcacgttggtaggcaagttgtaactttttggattaaggtcggtaattttagggtcgaaaacggcgcttaatgcgaaatcttgatgtgactgaaccattttgactgttttctgacccatggcaccacgaaaaccggcaacaagaacctgaatcatgcgagcacctccgcttcaatggctgatagttctggcacgcccagtagatgggcgagttcctgctgttggctggcgttcaggggtagtaacggcaaacgtgggctgccgacttgaaagcctagcgcattgagtgcagctttggttggcgcaggggatggaaaatggaatagagccgccatttttggcaacagttggcgttgcaaggcggcgactgtggtgatgtcgccacgatcgagtgcggcgtacatttcacggatactgtgagcgtaaagatgggctgcaacggaaatgactcccatcccaccgagtgtcttgatgttgagtgcctgagcgtcttcgcctgtccaaacgttgaaagcgtcgtgcttggtacggtcaatgatgtcactcaaggcagggaggctgccgcattgcttgatgccttgaatcatgggattttgcgccagtgtcgcaacggttgctggtaacatatcaacaccggtgcggcctggaatgttgtaaatgacgatcggcttctgcgccgctgcagcaacggctgtgtaatgggcgatcataccgttttgatctggcttgttgtaataagggacaacaaccaaggtggcatcaataccagcaatgccgccaacttcatgagtgaaggcggcggtttctttggtgttgttagaaccagaattagcaatcacaagtgcgcggccatgaaccatatcggcgaagcgggtataaagcgtgattttttctggatgactgagtgttggtccctcgccggtggtagcaccgacgacaaaaccgtcagtaccttctgcgattaaatgatcgacaagtcgctgcatgacgccatagtcaatttcgtcgcgatcattgaatggcgtcacaatcgcggtgatcagttctgctttttgcatgatgaccctcctataaacgcgctacccagtccagaaacctacacataaggaccttggccgcaatggccacttatgttccggtttctacccgcgccagttcgcgctctgtcttaatgtaactactaatgataatttgtgctggcttacactttttcaagcattcgatgttcaagaaagtgcacaacggcggtgacaccgggcacgagtgcggcttcgtcaggtgaaaagtcggctgcatgtagttgtgagtcagggtcattgacgcctagccagaacatggtgccaggaatcttatttaataggtagccaaaatcctcaccggtcatgacaggctttgtatcgacaaatgtcacgtcaggatcatctttcatcacttgaataaagtctttggtgagtttgtcattattttcaacgggatagtagccgccttggttcaaggcaactttgacttggcagttaaaactggcggcaatgccttgaccgatgtcacggattcgttgttgcagaaagtcactctgctgctgggtgaagccgcgtaaagtgccttcgagatgtgccctgccggcaatgacattgcggatcgtacctgcgcgcatcaagccaaaagtaatcacggcgctgtcggttggtccgacattacgggcaacgaccgtttgaatctgactgatgaagcttgccgccgcgacgatcatgtcattggcattttgcggcaaggcagcatgaccgcttttgccgatgaggtcaacgttgatttcggttgtgccggcaaaaagggtgccgaggcgtgtgctgatcatcccagccggtagatctgggcgatcatgcaggccataaaactcatcaatgtgccaatcgccggtgaatgcgcccatatcgtaggcgagcttgccgccatttttactttcctcggctggttggaagaaaaagatgaggttatcttttggttgatgttcagcaaaataactgaggatgccgagggcgacagtcatgtggatatcatgtccgcaagcgtgcgcgatgccggaatgcttagaggcaaatggcaatccggttttttcggtaaccggcaacgcgtcgatatcggtccgatagccaatcgtacgctgcggatcgcgcccttggaccttgacgagtaaagcggttggcaggtctggcaaggtgcggatggtgagatatgtttggggcagcccttgaatggtttttagcaataaggcgtgcgtttctttttcctgcaaggctagttcggggatttgatggagttggcggcgaagggtgatgaggtcagcttccttcattaataagtcacagctttctgagttcgtcgagtaggacggttttggcttcggtttggtcattcacttgtttgatgactttcgcaggaacaccagcgaccacggtgtgcgcgggaacatcgttaatgacaaccgcgccagcagcaatgaccgcgccttcaccgactgtggtgccttcgaggacaacggcattggcgccgatcatgacgtgatcaccaatcgtgacgggcttagctgaaggtggctccacaaccccggcgagtacggtgccagcgccgatatggcagtgtttgccgacgattgcccggccaccaaggaccgctcccatgtcaatcatggtgccagcaccgatttctgcaccaatgttgataatcgcgcccatcatgatcaccgcattgtcgccaatgagcacctgatcacgaataatggcgccaggttcaatgcgcgcattagccgccttgatatccagcaatggaaccccggtgttgcggccggcggtttcaacataatagtcatctaacttggcttttttcaaaatgggtttaatttctgcccagtcgccaatcacggtgccggtatgtttaccgatgaaagcatgaacgcttttggggaaatgcagctcgcttagtttgcccttgagataaaccttaactggggtggtttttttgctattagcgatggtggaaataattttttgagtatctaactgtgccataatcggcctcctatttggttgcggcagtggcgtcggtttgagctggagcaggctgctcagttggtgcggcgtaatgtaagtcatttttaatgagatcagcatcggtttcgcgggtcacgaccaactgggcttggccattttccacgaaaacaacggcgggtcgcggattgcgattgtagttggatgccattgagtagccgtatgcgccagtgtcaaaaacaacaacgacatcgcctggtgtggttgtgggcagcggtgcatcatcgatcaaaatatcgccggattcgcaatacttgccgaccaagtggacatgttcagctggcgcagcatttggctggtcggctaaaacggccgtgtaggttgcttgatacaaggcaggacgaatattgtcgcccatgccaccgtcaacggcaacgtatggccgcaatcccgggacatctttacggctgccgacggtatagagactatagccggctggcccgacaatcgaacggccgggttcaatccagatggctggcaacggccagttaagcgtttgactttgtgatttcaaggttgccagaattgccttaacaaaggcttctggtggcagcggatcgtcttgcttggtataagcaatgccgaagccgccgccaacgttcaggactttggggatgaagccgaattgctgatgccagttattaaggacatgcagcagcttttgggtaacggcttcgaaacctgctacttcaaagatctgggagccaatgtgggcgtggatgccaagcaggttgagatgatcgtcggctaaaatgcgcttggcggcttcatctgcttgaccactagcgagatcgaaaccgaatttactgtcggtttggcctgtctggtcataggcatgcgtgtgcgcgctgataccaggggcaacgcggattaaaacgtcctgttgaccaacggtggcacctaaaaggtcatcaaggagatccagttcgtgaaaattgtccacaatgatggtgccaaccccggcatccaatgcttgtgtcagttcagctttgcttttgttgttgccatgaaaactgaccgccgccattggaaaattggctgcctgagcggtgtaaagttcaccgccggacaccacgtcaacgtgcgcgccttctgacttggcgacttcgtacatcgcaatggtcgcaaaggctttggaggcataactgacggcatatgacacatctgcttcttcaaaaacacgtttaaatgcgcgaatttgctggcgaatggcgccaacatcgtacacataaagtggggtttgaaatgttcgggccaactggctggcagcgaccccgccgatggttaattggccttcatgatttgtggcaaaatccataagttcatcctcccgaatttggcagggcgatggcaaacgaaaagggatccttttgtttggccacgcgtcaaacaaaaagatcccaacttgcaatctacttgaatgatagcgccccgcttaggtttctaagcgacagtacaggatttgttcaatcctggcccaacaggcttgccgatcccggcgcgcccatttcggcaaccgcccctttggcttgatgtcatcacgaaggatcccgctcgatcaagctactcatgttggttgcaacctctatctgtttgtcaccagcctataataaaaagacgtggacgtcaaataaataatgagagagagcgcgaacaggcccgcttagaaaccggagcataagcggcctcaagcctcaatggctgggtcttggccattgaggcttgaggtccttatgtgcaggtttctgggcctgttcgcgcgttttaagtgagataggtctgtcttcgaggcttttagttctcctatagttggcatttgtccgatagtccgagctggccctgcggtgacagagactggtgactgtgaactcaggtcattaaaaacaaatttaaaaacattgtctctatgcagtaacccgaaaacgtgtcatgttagcgacatgctggggcttgtgtttctgggagagtctgttaaagtacaggataaaatgacaaagttctcatttgtcgtgacgtctaggaggcagtttatcgtgcgtgtcgtaaaatttggcggttcatcgctagcaaatggttcacaattcgccaaggtcgtggcgatcatgaaggctaacccagctcggcaggtgatcgtgacgagtgcgccaggtaaacggcacccgggagacaccaaggtgaccgatttattgattcagtatgcacaggcagtgatgcggcatgaagctgtggctgccattgttgcagaaatcgttgctcgatatcaggcaatcgccgatgattttgagctcgaagcatcgatcatggccgcgattgaagaagagctagaccagttaccaaagttgactttcaagaacaatgattatttaatggcaggctttaaggcgcgcggtgaaaagttgaacgcgtttttaatgaccgcggtgttgaatcatgaggggattgaggccacctatggcgaaccgaagtcgttaggaattgtggtcacagatcatcccaatgatgccgaagtttcacgtgaaacctatcgcaacctcgctacatttcgacgaccaatcggggttttggttgtaccgggattttatggctataccagcgatgacgatattgccaccttttctcgtggtggctccgatatcacgggagcgattttggctaacggttttcatgccgatttatatgaaaactttaccgatgtcgatggcgtagcggctgctgacccacgggtggtggcgaatccgcaaatgattcgtgaaatgacctatcgggaaatgcgagagctgtcttatggcggctttggtgtttttcatgatgaagcgattctgccagcgattgctgggcaggtaccgattaatcttaaaaataccaatcatcctgctgctccagggacgatgatcgtcccagaacagcattttgtcccgaagcatgccattaccgggattgtaagttcccaacattttggggcgatctacctgcatcgatatctgttgaataaggaagttggcttcactctgaagatccttcaggtgttagcccacaatggcattagttatgagcacatgcccagcggaattgatgatctcaccattattttagatgatcgccagctaactgaggccaaacgcaagacaatttgtgccgagattcaagcggcggttcatccagatgtgctgaagtggattgatgactatgcgatcatcatggtcgttggtgaagggatggcgcaacgaaccggattgattcaaaccattctacaaccgctcgcaaccgccggtgttcatgtctcaatgattaatgagggggcctctcagatttctctgatgctgggaacctcacgtgaatcggccaatcgcgctgttaaaacgatctacaatgctttttttataccgattaatcaacgtttggaggtgcactaacatggtgactttgcaaaaggttcatggttccgaaaatagtttctttcttttcgatgaaacgcagttaactcagccgttgacaaacacccaattagcaaccgtgacccaacagctaacgaacgctgaaacaggtttgcttggcggtgcggacggggtcttggcaatcacggcggcgcggggaacggctggcaaaatgacggtggtcaacactgatggtagttttgctaaattgtgtggtaacggtctgcgcacggttgcacgttatctgagtgaaaaaactgggcaagcgacgttcaaggtgcacacggattttgctgatcttgccgttgctcgtcagccgcaactggcagaaggcgtaccggcctattcagtggaaatttcgccggttagttttgcgcctcaggacttgccatttgccaatcttggcgttgaccgaattgtggatactgttttgccagcgattcatccgagcttgaaattcaccgccattgctgtgcccaacccgcacttaattgctttcgtctcgcctgaggtattagctgggtccgatctcgaacggattggcaagatgctgaatgccaaaaatccttattttccggaaggggtcaacgtgacttttgctgaaatcttagataaggataccttatttgctcggacgtatgagcggggtgtcgggttcaccaatgcatgtggcacaggcatgtcagcaacgaccttggcttttattttgacgcatccagaggaagctgcttttgatcgggtcaataccgtgtataatccaggaggaatggtcaaaacaattgtccatcatgacggcgagcgttactggattgaattgatcgggaatgcaacggtcacggcgacgattaccttgccagacacggcgttactcgcaggcgactggcaacaagctgagattcacgcgactggcgaacaggctgagtatgaacgatttattgacgcactgccgcatcggaagttagcaaacacattgacagaaggagtttagatcatgagaggttatcacgtagcagttgttggggctactggagctgttggcacccggatgttaaaaatggtggcagaaagtaaactgccgattgcgtctgtcttggcacttgccagcaagcgctcagaaggaaagcaagtcccttaccgtgatgggacgctgaccgtccatgagacgaccgatgattcattcaagggcattgatattgccttattttctgctggcggttcagtttccaagcgatttgcatcagccgcggttaaagctggggctatcgtggttgataatacgagtgcttttcgaatggaaccagaaattccgctggttgtcccagaagtgaatccggaagcgttgcggcaacacagtgggatcattgcaaatccaaactgttcgacgattcaaatggtcactgcgcttgaaccgattcgaaaagcctttggtcttaaacaagtggtcgtttcgacctatcaggctgtttctggcgctgggcaatcagctgtcaatgaattgcttgaggaaactcgcgctgcattggacgacaaaccgcttgacccgcagattttaccaacggcgggtgacaagaaacattatccgatcgccttcaatgccttgccgcaaatcgatgttttcgaaccggatggctatagccatgaagaatggaaaatgatccacgaaaccaagaagatcatggctggggatatgaacagcgataccatcaaagtaaccgcaacctgtgttcgaattccggtaccaattgcccactctgaagaagtgtacttcgaagtcgaagacgacaaggcaactgccgatgatattcgcgaggcattggcgcatgctcctggtgtcgttgttcaagacgacccaagcaaacaagtgtatccgcaagcgatgaacgccgttggcagcaaagatgttttcgttggccgcattcggccagatgcagaaaacccacgattcttccatatgtggaatgtttccgacaatctattgaaaggcgctgcttggaattccatgcagattgctgaaacgatggatgccatgggtctcattcaacctaagtaaatcattcggtgaaaaagccggtatcatcattgttcaggcggttctgaacggcgacgatgccggcttttgtgttgctttgagattattcaaaaataacatccggatttcttgagagaagcttaaggttggtacgcaaggattgaccatccagattaaataactataatagttaaaaaacaaaggagcagttgtcaaatgaaaaagcatcgttttgtcatcgcactggtgggtctgtcactctttgccgccagcagtacgattgcggctgatatgacgcaggcgaatatggatcaacacagtgtgacctacacgatcaaaggtgacgggttagtcatcttcgacaaaactcgaacctatcgaacaaaatcaaccgctgctgcctataaaggaactttcgccgccgatgcaccaacggccagctttgaaaaggtcgggacactggctaaccacaaggattatcgcgttacccgcaaaatcaaagtaaaagctaagatgcaaggcgctgctgcacagacctttttctatgtgaatgggcatggctgggttaaaggcagtgacttgacgcgggagtgatttgttttaaaatcaataccttcatctaatttaaataaccgtgatgaatcttttatatgaaaaaggttcatcacggctttttatttccttatcagatgtatgaatatatttatggtaataatagttgacgtagcactggcaggcactatacaatcaaagctctcttgatggactagtctcatcacctcatacgtgagtgaggcttctaagctagagatgacgcatcatagttttatctacttctagaggatgtttgaaatgcgagataagcaaaggggggtatcctgtggtaaaggttcattttggtctcactcataaaaaagttgattcagttctaatcattcaattctttaacgccggtattatctgggttcataactcaaagcgccgttgggaattgactggtggcaagttagaaccgggcgagacgatggtgcaagcagctgtccgcgaatcgtatgaagaatcaggtgctgttgttcaggccagtgcgattgtgccattgggctactatgttttacctactggacacacaacagcagtggttagtgctaaagttgaacgtttgcaagctattcctgcgtcttctgagattgatgatcggcaagtatggtttaagcctgtcccggatgctgagcgttcttttcatgatgatatttacgcccagatttttcaacatattgggtggccagatgagtagccgccaatacgggtttctgctgaatattttatcggtggccgtgatggctgtgacaccggtcatgaacaagttctcgatgatcacgctctcgccattagctgcaagtttctacaatgcgcttgtgtcattgatcctgactttggtcacgatcgcctttaccaaaacaaaattagtttggattaagcagccgattatttgggcgttggggctgacgaattgtttaggcatattcttgcagtatatgagtcttttcttccttgatccggtcagcgtcgggttggtcggcaggttttacattgtctttgcgatattgctttcagtgcttctgctacgtgaacgatttgatcgaaaagagattgttccgatcgtcttatgtatgattggcacagctttggtatctgacttctccggtgatgttaataacatactggggctggcttgtgcgctcggctacacgtttagctttgccctgaccaataccttagccaaaaaagctcttatcaacatagacgagaagatactactcttatataaccaaggcaccgccgtcgtcattctaggcggttttttactcggaagcggacaattatccctcgcgccgaatcttggcatgggtgctgtcgccatttcagctttttgttctggctttttgggactgctactcttttatcgcggcctgaagttgatttcatttcgcgatgctaatcttattcgggcattgaatcctatttttgtcttagtgtattcattgccgttcttcacaattcaaatgacgccagcgtttctgcttggcggtttctgtatcattctttcgattgtttggatgtcattgccgatgaagaaggttggcgttgattgagacgaatgtttcaagcggtgagttttttgaaaaaaaggaattgttctcctggaaaatttgcaaatgatcaaaatttgagctgctacataacttgtagaatttgaatagaacagcatataacggaaaggaagcaagtgcacttaagattaaagctcgattatagagaaatcagctcattcatggttttcttgacataaactcatactgggagtaaaaatttaaccattctaggctcggagtaacttaaagaaaactggacattgcttctctatatgaggaaagtcaccgtggcaaataaatctggagactcaattattaaaccgaattgcttcggaacgagcgcagatgcaattagacataaccagcaaattcattatgtagaagagattatgctataggcgttgaattacggcagatgttattgcttttctagaagttttctagacgataatagctgcttttttggaatttcttggagatgatctgactgatgaacccaattataataagaacgctaaaaaagcatggcgttgcttttacgttactagtaatatttacgattataagtacagcactgatcactgggaatacatatttagaaggtagattgttagacagtttggtttatagtcatagaccgacactttttataacattctttgtgcttatgctggggattggaattcttagactgtttttttcgttttttacaagtcacatacaaatactaaccaaacaagagacggtgcttgagttaaatagaaaaatattttttgaattatttaagaaggacactcttagtatacttaaatggagtccaaccaccttgagttctcgtattaatgatgatgtgaccgagatagtttcctttttctcagatacacttgttaagctgtgttccgtgattgtatccacgatcacgatctctgcatatgtattcagtgcagatccgaagatattcatcataatgattatcttcatacctatctactttttaatttacattgtgtttcgtcccaaaatatacagtataaacttaacgatgaaaaataagcaaaacgaatactatacgacgagaaatgatttcgttggtaggtatattgaaatccctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccgttcattcgggtgataggcatggcaaaagtaaaccggtatccgatagcgctttgtaagcgcctgatcgcaggaaaactctttaccgtgatcaaccgtcactgatcgaaccggacccggaaagtccaccatcagtcttgcaaatcccttgagaacagcattttgtgataagttttcaagcttagttgtcgccattaaacgtgtcacccgatcgacaatggtcaaaacagcagcctttgacccgcgaccaccgcgaactgtatccatctctaaatgtcctttttcggttcgccgattagctgactcactgcgaatctcaattgaggtgcctactgcttggttatagcgcgaccgaaggtcttgtcttcttttatgacgtttaccgtgatcaaagagttggcttggctgaaaatcgacttgtctttgataaatccagtggtaaatcgtgtgtggcgcacagtgaacggcatgaccgaccatttcaggggaccaacctaggtttagcttctcagttaccatccgcttcaacttaggcgttaaaatcgagtgccgaccacaacgatgccgacaagtatcggcatgatcctgagctataatggcgcagtaatcaccttcagggcaacggtgaagctcatgcctaatagaaatacgagagcggcctaaggtcgcggcgatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggattttaatataaaaatgtttccagaaagcaagaaagattcaaagatgttctattctcaagatttgtcttgttcattcgaaaatccaggactgtacgttatttcaggcgataatggtattggaaaaagtacattcgtacggacaatcacaagaatttaccagcctaaactaaggggcagtgttttgatcaatggactggatgtaaataaaatagatatggatgcattgagacaaaaagaaatgggattcctgtttcaggatgtgccatcgcctcatattaccgtgagagaatacttatctgatttagaaagaaatggtttcttgaatgatttaaaagaatcaagaccttttttaaatgtgtacttttcagatgtattcaatttggctgatatttatgaaaaaaaagtagatgtactgtcaagtggtgagttacagcttgttcgattgcttgctgcattgggcaaaaaagatgccagtatgtatattttggatgagcctaccgcgaatatttacccacaaattcggtctgccgtgatttgtttgttacaagaattaggtaaaagcaaattgattataaccatatcgcatgacgaacatttgataggccttggtaagtcaattgtaatggaatagcaatgaagaatcattgaatatatggtgagataattcaatggttcagttatttctgaagtgaaagtactgatataaagtgagctcattctaagctagttcttcaatagtgctgtaatcaattttctgaaatagacgatttaaacaaaataatgatttctgataagttcataaggagtcgtttcggggagacgaagatttaaagtatagcgggaagatgtttactttctcctcttaatgtctaatagttcatttctttgttgatgcgaaaaatgaaacgaaaagttgccgcacaaattctctaatagcaggtgccactgccaagagctgaagaagcttggtagtggcacttgttttactttgaagatagagatgaacattttagaatcataaaaatcacttagttgataaccatctataaaatatctatgccacgatattatctatattataatttgccatagataataaaatggttctcttttggtggactattatgtataataattggcgtaagcgcttgcttgtaggcgatagcaatgataagagtagaaaatataggaggggaatatgaaattctctaaacgctcaaaacgatttgatataatcaggcgaagtgccgtaatagtttttgcgctgatcagtatgacactattttttcaatttaatagtggggttgaggtccacgcaacgactaagactgagtttaatgacactgaaatcaacagagaaacaagtgaacaattaaaaatgatcgatccgtacttaaagaatgttgatggtatcacaagttttgactatgatgctgccatgaatgacaatgtcgatcccgttgtcctaaaaattggcgcagaaataaataaatgggctcgcagccttaaaaatgatggtccagaaaaaggtatgctattctcaatggccagatttaatttattggtgtatggaaattattgcggtaaaggcaacaacggcaaagcaccgattgatgatcttgatggcgcatgccaagcacatgatacatgttatgcgtggggcgggaacaatgagaagtgtaatcaagaatttcgtcaacgcttattaacaattatgcaggagacatcgctttttgattacaagcacattgttgccgttgctgcatataaactgtttggtggttgaaagttcaggatggataagtgccagaagaggactttcgtgtcatttaaggtttctgctagaaccatccttaatggagaaatgaaagatgaaagctaaatcgaaaatcgccattggtaatgtcggtatcttgactgtcatatttgccttaatgaccatcataactttctctggaataaagaacttcgttggcatcgagcttggcacagggttcattgggctattagtgattgccttgctgattatctgctggcaaatttaccttttattagaaaagtcagctcttggctggagctttaatattatcatcggtgtttacacattggttgttggagcagccatctctttcattgcctcatttttcattggttttgcgctattcccttgattttctcactcgcaaataacgttaaggaaaaagccctgaagacgaataaagtcttcagagccttttttcttaagccgaatgcttgcttcacaatttgcgttttgttggtatgacatcaaggccttacttagtgctaattttcttttttccaaccagccaaaagtgcctgaatgcccattaagaattgttcgtcactagtaaattgttgttctcgtattggttgcatgaattgattcaagagatctgattgcggatgtgctgcgcttagcaagtttggttcaagttcgctcatactttgaggattgacagcttcggtccagacaaaccctaatgtgtaagctgttaaggagttgattaaaaagactgttgttggctggatcgccaatccctttgttgtccaaatcgttaaaatcttttcgactaaagcaaattcagagtgtgttgataacggacgagttgaaattaacggtaatatgttgggatgtgctaaaagtgtttgacgtaaacgagacattaaaccagtcacttgatcttgccaagtcgcattggcagcatcctgatccaagactaaaacacgttgccatagcatctcaaccaaaccatcaaaaagtgcctcttgattaggaaaataacgatacacagccatgggcgagactgacatttcttgtcccaatttacgcatcgtgaatttttgaagatcctcttgatccaatagctcaagagcaacttgtaaaatataggaccgacttaacgttgttttggttggcttgacaggtttcacgttgagcttttccttcctttcaagagacaataaattaagaactaatcagtgaaaatatacccaatataggcacgacaatcaagagaatacagacatcgtggtgatctatttgacgccaaatttaaactttttcttgctaggcaagccttctttttttctgtaaaagccatgccatactcatgaaaatgatggtgtagagtgcaattacccctaaggcaaggctgtctttgctactgccatctagcgactttcctcagcaatgtaatgctgaggaaagaaatattgtaacgtttcttgcaaggttccttttttgactgtgaacaacccgcctgacagcatgagggttaggactgtcagaattgttccgatacccatagcgccttgcttggttcttgtgagcgttgcaatcatcaggccaaaagcagacgaaaagatgttgatgaggacgactgcagctaacaatccaactgatagtttaatgccaaatagtggcaaaatactgattgtagcgacgagacttatacagattagtacgaaaacattgaaagcaaaatgttggaataagtaagcgcgattggagataccactaagataaattcgctgatccataccatcacagtcatcaaagtagaacttgtacaagattaaggataacatcattgtactcatcaccaatatgctcaggaagattttgaacgtgtgcgttttgacgccaggttgctttgtatagacaccggtattcaaataggtgcttagttgtttttccagagccgaacttcgaacggtggttacttggtaactgccgtttctcttggtgacataggcgtcgtatttaccgagaatcaaattctgataagcattttgattgtgggttgcttgagtgaattcaattttctggctttttatgggtgtgactttcagcaatttcgcagcactagcggtcaccccgatttctgccgttggggttttcatcgtcacagcgaacgcggtagctgccgtcatggcaatgagcacaattgctgtgataagtaggtaggcaggttcctttatgaagcgagtcatattacttttgaaaattaataatttcattgttatccctcgaatttttccggacgatacatcacatgaataatcactaagaagataaacgaacccaataacagtatgccgatggtactggagagttcgtgaaaattatgatcataaatgatgccaaaaaagctatccgccattttggcaatgggtgacatatcagcgattgcagcaatttttttgccaaaaatagtcatcgggaaaaagagacctgaagcgatggcaaacacgttgatcaaaagatttaatagattggttgaaagatcttcgtttctgataatgacacaaaaggcaccaccaaacgtaatagcaaagatgacaaataccaggtccaacaacagcagaccaccaatgttcttaccgccaaaatcgactaatccaatggtgttgaatagcagcatgtaagcggccatgatgatgtaagcaaaaccgattgaaaccagcaatttggataagtagacttttgcacgcgcaatgggtgcataaataatccgataattggcgtattttacatggctgccaaaaagcatttccggcaagatgatgaccgttgccatcgacagataaatcatcatagtgaccccataatagtcatacgaggtcaaaacatcatcgctgaagataccactaaagacaaagcctgttaccaaaatgagtaaaggcgggtaaagcactagataaatcataattggtttgtttttcaaaagcgtcaaaatatcttgatgcatgatcgtgagcataggattacctcctcttcaaaagcaacggtttatgcgcttcttaaacgcgatcactggcacagaaacttgcacataaggaccttgggtgcagtggctatgggcccagtcatcacacccaaggccgcttgcgctccggtttctaaccgcgccagcttacgctctaatcacgtaaccgtttgccggttaaggttaaaaatacatcttcaaggctgcgttcttgtttgacgatgtcagtcagagcaagcccgtgtttgtttaaaaagacgagcgagcggttaagggaaaatgtatcagtcattcgtaaaagcagatcatttctcccgaggcattctgcttggctaatacctgtcatgctttcaagaatctggacatcttttgtactgggtgtaccgactaaagtcagccgataggtggcaccgccaaatgtttttaaaatattagcaagtttatcgttaagcagaactgtcccaccgtccatgatgatgattcggtcacagatttgctggacttcttccatgtaatgagtgacataaatgacagtagcgccgtttttccgaagtaatttaattgattccaaaatatgattgcgtgattgaggatcaatacccacggttggttcgtcaaaaatgattaagtcgggctcatgagcaattgcacacgcaatattcaggcgccgtttcatcccgccagaaaaagtttccggtttgtcatcctttcggtctaaaaggccaactttttccagtgcactatccaccttttcacgcatgacatcccgtttcacgccataaagagccgcaaagaatttgacgttttcatacgcagaaatatcttcataaagggcaatgtcttgaggaacaatgccaagtcttttcttaatcgccttgttacttaagtccggattgttgaaataaacgatcgaacctgcatccgctttaagcaacgttgaaataatgttgatggtggtactcttgcctgcaccatttggtcctaaaaagccaagaatttcgcctgcctcaactgtaaagttcaaatccgtcagcgcttttttaccagttttataggtcttgcataagttggttactttcaaaatattcatcacatttctccttagactaggtttacaaagtaacttgtgtttacagtgtaaacttgcaattagaaaaatactagcaaaacgagaaaaacttttgatatttttttgtaaacgtgatactagcaggcaattacaagtcgctcgcagaatccaattgcacagtatggtagaatagctaaagaaatccttaagtatctgcgctaagtgaaagcgagtttttctatatgaagaaattgtttgagcggattcgtatgccggagtttcttgaagacatgcgaatgcgatatgcagctattgcgatggtcgtgctggcggtgatcggtattctgatgggagcactgatccgtccgtggttggctttgttgatgctgctgattttgattagtctagtggccacgattttttatgccctagaaaccattgccaagaataccaatcagtatatttcggatctcagttatcggatcaagcgtggcgaacaagaagcgctgatcaaaatgccgattgggatcctgatttatgacgagaatctcaatattgaatggacgaacccattcctgcagaagtattttggcgacactgacgttcttggtcagccgttggaacatgttgatgcggaattggcggagttgattcgcagcaacgaaaacaccaatgaaacgaaaatggtgacttggggccagcatcagtttgagattatcgtgcaaaagagtatcggggttgtctatctgatggacgtgacccgatatgctgagattgaagagcgggcagaagacgagaagatcgccattggccagatcttcattgataactatgacgagatcacacaaaccatggatgatcaggtcattactaatttaaatagttacgtcacgaatcagctgacggattgggccaatcaatttggcatgttcttgaagcggattgacaacgatcgctttttcctgctggcttatgccaagtcgctgaaggatgttgaacgtgacaagttcaaaattctagatgtgattcgggaagaaacctcgaaacagaattatccattgacgctgtcgctggggatcgcatatggcgatgaagacttggctcagttagcggtgacttcgcagagtaacttggatctggcgcttggtcgtggcggcgatcaggtggtggtccgcgccaagggccacgaagcccgtttctatggcggcaagacgaatccaatggaaaagcggacgcgtgtgcgggcgcgtatggttgcgcaggccttgcaagaattgtttaagcagacggacaaggtctttgttgtcggccataagcggccggatatggatgcagttggcgcctcgatggggattcgccggattgcgcagatgaatggcaaagagtgttacattgtgattgaccctgaccatctgcactccgatgtcgaacgcctcatgggccaagtgggtcaagatcccgaagttgctaatgccattgtgacgccggaagcagcgctgtcgcaagcaacggatcagagcctgctgatcttggtcgatcacagcaagccgtcgatctcagcggcgcctgacttgtacaaacggttggcggcaagaacggttatcatcgatcaccatcgacgcggcgaagaatttccggacaacccgatgctggtttatatcgaaccgtacgccagctccacttgtgagctgattgcggagatgtttgaataccagccaacaaatgtgccaagtcttgataagcttgaggcaacggcgatgctggcagggatcacggtggataccaagtcctttagcctacgcaccggcacgcggacgtttgatgctgccagctatctgcgttccatgggtgctgatggcatgttggcgcagaacctgttaaaggaaaatatcgacagcttcatccaacggaatcatttgatcgatacaattgaaatgattgcgccaaatatggcactatgtactggggaagaggataagcgttatgacccagtgattgcagcacaagcggctgatacgatgttgtcactcaatggcgttgatgccagttttgtcatcacgaaacggccaagcggtgatgtcggcatttccgcccgctcgactggggatgtcaacgtgcaggtcatcatggaagccatgggcggcggcggtcacttgagtaacgcagccacccagattaaaggcaaaacgatcgccgaagttcggactgatctgcttgctcagatcaaaaaagcagacgaagacgcatagaaagcagggattttgatgaaagtcatctttacacaagacgttcgtggcaagggcaatcgcggtcaggtgaaagaagtacctgacggctatgctgaaaactttttaattcgcaaggggctggctaaagcagcgacaccgcaggctatgagtgctttgcgcggccagcagcggcttgaagagaagaaggaagctgaaaagaaaaccgaggctgaggccatgaaggctaagatcgaagacgacaaaaccgttgttcagatccaaagcaaagccggcgaagattcccggttgttcggttcgattcctagcaagcagatcgcgcaggctttggataagcaatatcagatcaaagttgataaacgtaagatcgatctgaagcagcctatccgttcactgggtttcactaatgtcacggttaatttattccctggcattgatgcccgcattcgggtacacgtgattgaacaaaaataagaatagttattctgccagaagacgcgaccagatgatcgcgtctttttgtctatctggtccaaattagtgggttgtggactgagtcaatcaccggtgatacagcagtgaccattgcttttcgttaaattgtttgtgtagttcgactgtatgcggtgatgcttgtcttgactgcgggtttaacgtagactgttagggataagcgacaaaaaatttttgacgattaatctgaaggaggacgcgcatggataatcaattaattgaccagcagccgccgcatagtgacgaagcagaacgtgccgtccttggcggcatttttctgaatgctgacacatttccggatgcacaagagtatgtcacggcggatgacttctataagaaagcccaccggctgttgttccaagctatgaccgatctacaggataacggcacagcgattgatacggttacggtgtcggattatctggacaatcataacaacctcgatgatattggcggggttggttatattacagatttggttgcggcgacgcctattgccagtaacgtggtatactacgccaaaatcgtgcagcagaagagcacgttacgcaaactgattagtacggcgcaaaacattgccagtcgcagctatacggaacaagacgatgttgaaggactagttgaagacgccgagcgccagattatggatgtctcggagaaccgcaatcaggccggcttcaaacagatcaaagatgtgctgaatcaggctatggcgcagattgatcagttgtatcaaaatgatcaggcaatcaccgggttgccaaccggtttccgtgatttggacaaaatcacgacggggctgcatgaggacgaaatgattattttagcggcgcggcctgctgtcgggaaaaccgcatttgctttgaacattgcccaaaatgttgggacgaaaacagacaaaagtgtcgccattttcagtttggaaatgggcgctgaacagctggtaaaccggatgttgtgttcagaaggtagtattgatgctaatcacctgcgaactggtcagctgaatgaagaagaatggcagaacttgattatcgccatgggtagcttgagtaaggcgaagatctatatggatgacacgccaggcatcagaatggcggagattcgcgcgaagtgtcggcggctagcgcgtgagcaaggtgatttagggctgattatcattgattatttgcagttgattgaaggttctggccaagaaaaccgccaacaggaagtcagcgccgtttcccggcagctgaaaaaactggcgaaggaattgcatgtacccgtgattgcgttgtcccagctgagtcgtggcgttgaacagcgacaggataagcggccggtgttgagcgatattcgtgaatccggttcgatcgaacaggatgccgatattgtggctttcctgtatcgtgatgactattaccgcgatgcagaaggcgatgaggatgacgacgatcaaggcggcaatgatgacggggatgacaatgttggtgaagttgaagtcatcattgagaaaaaccgttcaggcccgcgtggtaccgtcaagttgttgtttgtgaagtcgtataacaagtttacgaatattgcctataatggtccggatcaataaaccattagcaagaaagattagaaagttatttttagatttaagcgcaagaaagtgagggatgccgcatggatgccattttgatgagtttaatgacagcactcaatgaacacctgctgatcaatgtgtatcagcgcgataccgacgatttttacaccggatacgtacaggtgttaggtcatgatgcggttgttctgggaacctacaatgattcagggattgccgatggatgtgccttgatcgcattttctgcgattgatcaggttgaatttgccggggatgatctcgatagcatgaattttcgaattaacttggcacaggcccagcatttcttgacgctgcaaggccaagaaaagccattgcagttcgatgcgacacagaacttaattcagcaactggcgacgcaggctaaggcgaatggtcaaatggtcatggtcgtggtggccgatgatgatgcctatcttgaagggcaggtaacagctgtggctgaggatcgctttagtatggcgatcttcaacaaattcaactacaccgatgtgcgcgccttgcaggttgatttctcggatattttagtcatggaattccatggccttgatctcaaactggaaacggaactggtccggcaacgtgatcatctaaagcacgtggccaccaagctgtaccaaaatgacggtcaactggctggcgtgtttcagaatgccttggcgaacaatcgcttgatttcagtcgtacccaagggaccggaagatcagttctttgtgggtcgcgtcaaagcggtcaacgaccgggttgtggtgttgagtctcaaggacatggccggccagtttggtggctatattttactgacgttaccaagcatccaaaatgtcgcgacagcctcggattatttgcaaacgatcagcttttacgaaaaatgggatcaaacccatcacttcagccagcagccagtgttgaatgctgatcgtgagttcgatccaaatgatgacttaattcagaccatcatctcagaggccgctgggtttgaacgggtggtgcgcattaaagtagccgacagcgatgaacattttctgggttatccggaaaatgtcggtgaaaccgattttgacttaaacctagtcggaccagatgatggcgaaacggcgcaaattcgctatggtcagattcgtgaaattgcctttggccacatctttgcgtatttgcaagaggcacaattgaaaaatgctggacgctaatctgtacttggcacataacaagtcgagccatcgttaccatctaggaattgggctttattagattttaaatactctgggaaaaaatctgggctagaaggtccttgccgtgccaaactccgcaatctccggcctgctggggctggaacgctgtgacggcgcttttagcccgcaaaacgcgcggtctaaaagtcgcctaacaacatcagctccaagcccggtcgctgtgttgtttgcacggctgagccccatctggcctacgattgctccgccgtggcactgagatttttaaatgctatcagggtatctatcaaaagacgaattgtgtatcaaccgcaagcaaaaaatcgttcctagagaaactgtgctttctctaagaacgatttttttagttggcacacacgatcactcagatataaggttaagtcaatctgccgtcgactttcatatactaactttctgattgactggtgacgcgcaggacgtcttcgccagcagtgatcgattgatctgtgaagctggtcatggcggcgacatgggtcatgttggtgatgacggtgatgattgtcgtacttttgccagctgttttgatggcaggtagatccatttcggcaatttgctgacctgcctttacggtttcgttttctgtcacatgaacagtgaaggggtcaccgttcaatgcgacggtgtctaatcccatgtggacgagaatttcaagtccggttgcggttgtcatagtccacgcgtgtttggtcggcatgatgctgacgatggtaccgtcaacaggtgcgacaaccgtgccatgacttgggacaatggcaaaaccatcccccaccattttttgagaaaagacatcatcgggcacttcggacaaggcttgaagttgaccagcagcaggggccacaaattgagtcgcatccgggctagttgctctagtgaaaggggtttcagaaacagctgctgtatttactgcgagcggttcaatgatggtgccgtcagcgctggtcggcaccatcgcgctttctggcacaccgaagaagtaagtcgccagaaaaccgcctgcataggaagccagtaggccgaaaacataacccagccattggtgattggcgatgagtggaatcagggctgcgccggaaggaccaatggtgatggcaccgatatggccgatcatgccgataacggcgccgccgatgccaccgccaatacaggcagttacaaatggccggcccagcggcagactgacaccatagatcaacggttcaccaacccctaagataccgactggtagagcgccttttatcaagcggacgagctgttgattttgtcgacacttgatccatagtgcaagggcggcacccacttgaccgccgccagccatggccaagattggcagcaggccggtgtagccaatgctcttgatcatttcaagatgaataggcgtcagaatctggtgtaatcccaacatgaccatcggcaagaaggcgaggcctaagatagcgcctgagaaggcaccgccaacttgtaacgtccagttaatcgtgccgaccaatgaacttgagacccaaccggcgagtggcatgatgaagaaaatggtcagcaggccgatggataagaggctgagcatcggcgtgaaaatgatatcgatggcgtccggaatgagtcgatgcaggcgtttttcaaccacagccaacaaccagacggcgaaaatgacgccgatgatgccaccttgaccaggagataacggttgatgggtgaagacgttgttgatcgtgatcggggccacaacgccaggcagatagactaagccgccgatgatgccgccaaggccagcggttgcgccaaactcggttgcggcgtttatcccaacatagatattaagaaaggtgaagagcccgccgttgatgacttttaagacagtaataaatgacgcccagctggttggtaaatcgccagcggttaacaaattggctaaaataccagcaacgccggagattaagccggcaccgacgaaggcaggaattagcggaatgaaaatagcggaaatatgttttaaagcagcccgccaccaagtttgctttaacttggctttatgcgctgcccgaacctctgcggctttagcttcaactgccgattgattcgattcagcaggcggttgcgtgttggctgggaaagggtcacctaatgcaacccctactcgatcaaccatggcctgtgcgactttgttgacagtccctggaccaacaatgacttggagcgtttcttcttggacaacacccagcacgccaggcacttttttaagtgcggcttgatcaactttggcctcgtctttgatcgtcagccggactcgtgtcatacagtggatcaatttggccacgttttgcggcccgccgatgtgggcgtagataccattgcccatcgtttgatacttatcttgtgccatctgttttctcctccgaacttgctgtgacagtttggctaatgaagccgttcgtttgtgtcagtagtttttgagcgtccgtgcttgatcgctgtgtcagaatcatgacgatcgctaatttaacgtgctgatcggctgcttcaaacgcctttgctgcagtggcggcatcgcaaccagtggcttgttgaatgatgcgctggctgcgaaccacgagtttttcattcgtcggcagcacatcgaccatgagattttggaaaactttgccaaggccgatcatggcgccagttgacagcatattcaaaaccaatttttgggcagtgccagccttgagccgagttgagccggtcaaaacttctggtccaacaggtacttcaatggcgatctgggcgtgctggctgatttcggcgtgggtgttgcaagcgaggctgatggttgcagcaccgacagcttgcgcataatcaagaccgccgatgacataaggtgtacggccgctggcagcaatcccgacaacggtatcgtctgcggataggtgccgttgcagcagatccgttttcccgagctctttagaatcctctgcgccttcaaccgcgacagtcatggctttcatgccgcctgcaattaggccctgcaccatttctggatcagtgccaaaggtcggcacgcattctgctgcatctaaaacgcccagtcggccactggtgcctgccccgatataaaacaagcggccatctttcttgagtgaatgactgatcgtctgaatggccgtttcgatagctggtagtgcttgttgtactgactgggcaacggtttgatcttcggcattcatgacggtggcaaagtcatggaccgtcatcgtgtctaatgccattgttttctgatttcgagtttccgtcgtcatttgatctaaattaattgccatgtttttagcctctttctttggaaaatcagcctgacaagttggctgataaacgttacgtcaagttaaagggcaggcgtcgtcggaaaattgatggaagccctttattgataaaaacgtacctgatatccacttttatttcaactattttcttttaaatgtgaaataaaatttcaaaaaaggctagaaaaaagacacgtcagctgcagacgcgtctgaaatgtgaaagcttcgaagactcatttaaagccgttgcgtaaaaattcacgataggcagtcactgcagcttttgattgatccgtggctatttttgctgcatcgtagtatcggctgacataggcatagtatagaatgtcgatgagcataaactgggtgtggagtgattgggttgcagcgaagcggttgcgggcctccatcggttgggatgtttgaatgctcacatcagcatacttggtgagcgaatttttcccgagtttggtggtgacaatcacctgcaagccagcctttttggccaatttggcagctagcacgacttctggcgattcacctgaattcgaaatgaaccagcaaagtgtccggttggcatctgcagttgctgcaagtggcaagaacaaattgaggtcatcactgacatgacaaggatagccaagcctcccccatttttgggcaatgttttgcgctgctaagtaggaagcgcccacgccgaacacaagcagacgatcactttgatgaatcaagttgataattgtgtcgacattggcttcgttaagctggtcgacggtttcgcgcaaggattggttggcatccgtgagcagtttgtgcttgatcgttgtcagcgtttcgtttttttgaatttcttgatcatccggttgatgggtatccccttccagatcagccgctaactgcattttcagctcgttataaccagtgaattgtagtcggcgcgcggcgcgactgacggaggccggactggtaccagctgctttagctagatcatgaacactcatcgttaagactgcttgactgtgtgctatcacataatcaacgattttcttctcggtttcagatagctcgctgcgggtactttgataattgcctttaacactcatttgaagcgcctccttgaggaaattggatgccaattagtcgacagagaaaaccaatgggctggtggttgtcagcgatagactggactggcatattttcacaatctatttctctaatgccagtaattgataaggggacagaaaccgagttttcattaaaatgtcaacaatttcagcctcagagcgtggctgtggctcgttaagccacagttggatgatatcaataatgccataaacgatgatctggctgacgtaagcatctggaatatcgtggataaaatgggcttcgccttttaattcggcgagatggccgagaattttatcacgtaacagtttggcgacgcggccaagtaaactcgggtcaccaactggacttagtaagaattgacaaatatcgcgccgctggttaattaaatgcaccatattgaccatcagcggcgactgcttaccagagacgatagcattgggatccatcgcggtatccatgccaatgtctaggccgcgttccagatcgcctaatagcgaagcttcaaccttggcaacaagatcgtctttatccagataatgcaaataaaaagtaccgcggctgatgccgcttgccctagtgaggtcagccactgaaaccttcgctagggtcttttttcggcccactgtgattaaggacgcggttagtgcttgcttcgtctgcgcagtctgttctgcttttttcatgagcttgctcctttactgaacacttttcaaaaaattgcacatagttattcccaaaagtatgttttatgatgttcctcgtaaagatgcttaacacgatgttcatgataaatcattttggaggttatgacaatggacaatttcatcacggttaaaaatgaaacgcgtcagtatggtagcggtgagcaaactgtttatgccaatcacgaagtttcttttaccatcaaacctggcgaaatcacggttattttaggcgcttccggtgctggaaaatcaaccttgctcaatattctcggcggtatggatcgcccaaccagcggtcaggtcgtgattaatgggcacaacattgcgcagtatgacgatcaccagttgacaacttatcgccgtgatcagattggttttgttttccagttttataacctagtaccgaatttaacggctttggagaatgtagagctagcgagcgaaattgccccggatgcgctagatccgaaacagacgatggtggatgttggattaggtaagcggatcaataacctcccggcacagctatccggcggcgaacaacagcgagtggccattgcccgcgcgattgcgaagaatccatcattgctgctagcggatgaaccaacaggcgcgctggattataagactggaaaaagtattttgaaattgtttgaggacttctcccatcaaacgaataaaaatgtgatgatcgtgactcacaattcgctcatcaagccgatggcggatcacgtgatcgaaattcacgatggtaaggttcaggctgattaccaaaatgagcagccaaccccagttgaacaactgaaatggtaggtgaggcgcggtgagcaagaaaacactttggaaagacatccgcaagtcgtttacaacttcatgggggcgtttcttctcaatcctgttactgatgatgctcggatcttttgcattggttggtttgtggattgccggtcccgatatgcgagcgacaggtgaaacgtatttcaaacagtatcatctagcagatttgacagttatcggcgaagatggtctggatgcacatgatcaaaagacgattcagcgtgcttctggcacagagcaaatcgaatttggttatctcaaagacgtgacgcttaaaggtacccattcaagcttccgaatcttatcaaaaccaactaagatttcgcagtaccggttggattccggacgtatgcctaaagcaaccaatgagattgcgattgatgccaattataaaagcaagtacaaacttggcgacacgatcaagtttgtgcaaagggcagatcaaaccggcagtaaggttttgaaaagaataagtttcaaagttgttgggtttgtgtattccccggaaattatttcgtcgatcaataaaggcaatagcacctctggcagtggtgatcttaagggttatggtgtcgttacaagcaataattttgattcagatgtttatatgatggcacggttaacttatcgcaacacaaaaggcttggatccatattcgagccagtacactgaccgaattcaagcgcataagacggcactgaatcacttgttgcagaacgcaccacaagctcgattagctgccattaagaaacagtatcaagccaaaattgatgccggccagaaaaaacttgatgatgctaaagcccaattgaatgcagctcaggagcagttaacgactggggcacaacaactggcgacggctaaacaacaagtcgcagcaaaacagcaagaactggatgctggcgttaaaaatggccaagcccaaattgccagtggtgaaacgcaactgcagcaggcatcgacccagttgagccagagccgacagcaattgaccacggcaaagcaacagttagtagcaggtcagcagcaattagatgacaagcatcaagcactagtggcggctaaacagcaattggatgcggccaagcagcaactagacaatagtcaacagcaactggctaccgctaaacaacaactgacgaccggccagcaacaactaaacgcgaaacaacaagatctaacgactgccaagcagcaattaaacgctgccaaacagcagcttgatgccagtcaacaacagctcacgattgctaaacaaaagattgatgccgctttggcacaaaacccagcaattgctgagaatccagcttttcaacaacagcaagccagttatcaagcgggggttgcgcagtataacggcgggttaaaaacttataaccagaacttagctgtatacaaccaaaacatggcaaattggacagctgccagccaagaactggcaaagaaaatcagcacctatcaatcaggtactgcccagtacagcagtggtttagcgacttacaatcaaaatttggaaacctataacaaaaatgttgcggcttggacagctgctaatcagcaacttcagcaaaagtccagcgagttcaatgctggggaggctcaactgcagcaaggtcaagagcagtatgcttctaagcaggtggcgctagcacaggccaagcaacagttggcagcgactcagcaatctggtcaacaacaacttgatgcagccaatcaagagattgtaactaatgaagcaaccttgaaaaccaagcaagccgcatatgataaacagtcaccatcggcccagaagaaaattcaagctggcacagttacacttgaggatgccaaggaagccttgagcaagctggaggcgcctacctatactgttgatacacgcagggaaacaccaaccggccagggctacacggtttacgacagtacctctaatattgtcgattcgttggccaatattttcccgttctttatgtattttgtggcagcattagtcaccttcaccaccatgacccggtttgtggacgaggaacgtatcaactctggcactttagttgcattaggttatacgcgtcgtgatgtcatcaataaatttacaatgtacggttttcttgcaagtttaatcggttcacttttaggcattaccgcaggacacattatcttgccaatgattgtctatcaggcttatcacaatgggatcaatgtaccgccgattgaattgcatttctatccgggtattagtgctatcgcgttgctattggcgatggtcagcgcggtattgccagcttggtgggtcgcttctcgagagctaaatgctcggcctgctgaactcatgttgccaaagccaccagctaacggatcgaagattttcttggaaagaatcccattcatttggcggcgcctgagctttacccacaaggtaacggctcgcaatattttccggtacaaaaagcggatgtttatgacgatctttggtgtggcggggtcggtgacacttttgtttgctggtttagccgtgcagcatagtattagcggcgtcaatgatcgccagttcaacgacatcattaaatatgacatgattgtcgctcaaaaaagtaatatcaccgataaacagcagcaacaacttgatcaactgtttcaagaaaaagcagttgagcgcaccaagtcagtctattatgaaactgttacaaagaatgccggtacagacaatgatcgtcaggatattaccatgatcgtgcctaaagaccagaccggattcagcgactatattcggttagcaacgcgtcagggtcaaacgaaactgacattatcaaatgacggtgcagtgatttctgagcggttggcttcgcttctgaacgttaagattggaagcaccatcacggtaaaagatgcgaccggcaccaagcatcaagtcaaagtgacgggcatcactgaaatgtatatgggacacttcctgttcatgaacaaaacggcctatcaaaaagcgtttaacacagactttaagccaaatggtcggttggtgaccttgaagaaccgttccattagcaatacccgggctgaagcggctaagtttatgcaggccggcggggttgaaggcattcagcagaactcagcgttacgcagtcaaattacaacgattgttcattcactgaatacgattatgattgtgttgattgttttagcagcagtgctgggggtggttattttgtataatttaaccaatatcaacgttgccgagcgaatgcgggaactttcaaccattaaggtgctgggtttttataaccaagaagtcaccatgtatatctatcgagaaacaattcttctgtccatctttggcattttcgttggctggggattgggcgaactgctgcatgagtacatcatcacagttgtaccaccgaataacgtgatgtttaacccagcgttgtccgcactaaccttcatcatgccgacattggtcattacgatcatcaccattgcacttggcttcttcgtcaacagttccttgaaaaaggttgatatgttggccgcgctgaagtcagtagactaaggtagattgatatagttatttcataccggtcttaaaaaagcgtggcggccttggtttttgacagggccgccatacttttgtcaaagcaacatggcttttgcaggattgcttcaagttgaattgagaacgaggagaatacgctatggcagaaattattgattttcacacacacttcttaccgcggttatatgcgcaagctttgaaaaagcatattcctggcgatccggatggttggcccacgccaggctgggatgaacatctcacgctcgcttttatgaaaaagaatcatattggctactcaattctgtcgctttcttcaccgcacttcaactttggcgataaggaagagacgatcgcaatcgcaagggatgccaatgatactggcgagcgcgtcacccaagaccatcctgatcaacttggttactttgcctcattgccgctaccctatgcccaagaaagtgtgagcgaaattgatgtggcattggcgcattcggctttgggattcacagttccgacgaatagtcgagggctttactttggcacaccaatttttgatcctgtttatgctaaattgaatcaagaaaaagccattgtgttaatgcatcctaatcgccctgcacaaggaccgatgaatgttaatattgatatgccaattccgttaatgggtttcttcatcgacacgacgatgacgttcatgaacttgctgcgatatcacttttttgaccgttatccggatattaaactcattgtgcctcatgccggtgcgtttctgagcatcttggccgatcgcgacgcggcatttgtcaaacagcaatacaacagcgatatgtttgcggcgttgcggcacgtttattttgatgtggcagggacagtttttccgcgccaactaccgatgctgttgaccctagcagatgaacaacatctcgtttttggcagcgacattccctatacaccgccattgctggcaagtcagatgatcaagttgtttaacgaaagggagtatcatgacaagatgtcgcggcgggtatcgcgactgcaacggtttgacggtttcttcaaccactttaaaaagcttcggccgctgccaactgtgttgaagatgtcatccaacatgctgacaggtgccgaaatcctaagcccggaaatggctcaggatattctggttaataacggtaagcgactgctggaattaagctaaataaaatcaatacgacgattttgtagaaagaccatgccgaatgcgacatggtctttcgtgtagagacgataaaaagcgcatttataatattttcgttcgtgtttttgtggaaaatgtttttcgtgtcattttaaagttcggattttgcttgtcttcaaggcgtcatcctgttagactaccagatggcgggtaaaaatgcccgcactaagccgtgaggagcgatcagttaatgggaactgtagttattgtcggtacacaatggggcgacgaaggtaaagggaagattacggatttcctgagccaaggcgccaaggtggtcagccgttatcaaggcggtgacaatgcaggccatacgatccatgcaaatggcgaggtttataagctgcgcctcgtaccatcaggggtactctacccgcatcagttatcggtgatcggtaatggtgttgttgtgaatcctaagagcttggtcggtgaattggcccggctcgcagaacaaggcgtgactggcgaaaatctgcggatttcagaccgtgctcacgtgattttgccttatcatattaaattagataaattgcaggaagcagccaagggcgccgacaagattgggacgaccaatcgcggcattggcccggcctatatggacaaggctgctcgagttggcattcggatggctgacttgctcgacaaagaaatctttgaagaacgcctcaaagctaatttgaaagctaagaatgaagaattcgtcaaagtttatgatagtacgccgatgaattttgatgatatctttgaagaatattatcaatatggccaacaattgaaacagtatgtttgcgacacctcaattgtgttgaacgatgcgattgacaaaggtgaacacgttttgtttgaaggcgcgcaagggattatgctggatattgaccaagggacctatccgttcgtaacgtcatcgaaccctgctggcggtgtgacggttggtgccggcgttggtgcctccaagattgatcgggttgtgggggttgcgaaagcttacacctcccgcgttggcgacggtccgttcccaacggaattgctcgataaaaccggagatttcattcgcaatgctggccacgaattcggtactgtaaccggccgacctcggcggattggctggttcgatgctgtcgttgttcgtcattctcgccgtgttgccgggattacggatctgtgcctcaactcaattgatgtgctaaccggtttggacaaagtcaaaatctgtgttgcctacgaacgcgatggcgaacgggttgaaaactacccagcttcgctcaagttcctcagtgaatgcaagccagtgtatgaagaactgccaggttggcaagaagatattaccaaagccaaaactttggatgatcttccggaaaatgcgcggcgttacgttgaacgcatcacagaattacttggtgttgacctgctgacattctcagttggccctgaccgtgaccaaaccaatgtccttgagaatgtttgggataaggtatcgcgctaggcccaccgcgatttgataattcaatagcgattttttaagagctgctaggtgaaaattcactggtggctctttttttgacaaattaggacatcattcatcggattctaaaagagcccagtgccaaggcggagcaagtgtcggccagaggaggctcgaagcgtcgtctccgctctaccagtcccatctggccggagattgtcgcaatcaaggtattttcatgattgacaccgttccttaaagtcggtatattgaagatgatatatgaacatatgctcatatgaacattaaatgtaagggcgggatcaaagatgaaaaaaaacaaggccattattttttatatgcttggcgtcatcaccttcattggcggcttactcatcacccaaccgatagctcgcgcggcgttgttggtttttgccgcgattgttgcgggttatcaagtgattgcagaaggtatcatggcaacgattcaagcaactagaaaacggcaccgtttttcgccaaatattcatctcctcatggcactggctgcacttggcgccattgcgattggcagttttgaagaggccgcgatgctaattctgatttttgctggcgcgcactttttggaggagtacgttgaaaacaagagccgcaaagaaattacggcactactggctatggcgcctcaagaagcgcggcgctataccgacaccggtgcattagaagttgtaccagtgacagcattaaacatcggtgatcaattacagattctgaatggcgctcaggtaccaacggatggcgttattattgccggcactgctagtctcaatgaagctgcgatcagtggtgaaagcattccccgtgaaaagcaaaccggcgatgaggtttttggtgggaccatcaacggcaagtcaacctttgatatgcgggttaccaagtcaagtgatgaaacagtttttgctaagattgtccagatggtgcagtcagcccaagactccccgaccaaaacagccagcgtgattcaacgttttgagccgatttacgtgaaggcggtattggctgtattgccgattgttttacttgcgggaccatttttacttcattggtcatgggcaaccagcatctatcgcacgatcgtcttcttagtggctgtgtcgccgtgtgccttggccgccagcgcggtgccggccacattgtcaggcatttcaagtctggcgcggcaaggggttctttttaaaggtggcagctatttagctaatctgacccagttaaaagccattgcgtttgataaaaccgggacgttgacggaaggcgtgccagtggtgacggacagcgaatttgtgtcggatgtggatgaagccgccttgactcagattattacagcaatggaaatgcaaagtaatcatccgttggcgaatgcgattgtgagccattattccaaaagtgatgtaccaatcacggatgtgcataacgaaattggcaaaggcttgaccgctgagtatcagggacacacttacaccattggtaagccgcagcgattcaagcaagttgatccggcatttcgcaagcgagccgcaacactcagtaagcaaggcaaaaccgttgttttcgttgcggtcgatcaaagggttgttggcctgatcgccttgatggatcaagcaaaaagcagcgctaaatcggccattaattaccttaaacggcacgacattcaaccggtgatgatcacgggggatgcgcaacaaaccggtgaagccgtggccgccgacctgggaattgatcaagtggtcgctaatgtgatgcccgaacaaaaggttgccgtggtccgtgagctgcagaccaccatgcggcccgttgccatggtcggcgatggggtcaatgatgcaccagccctagccaatgcagaggttggcatcgcgatgggatcaggaactgatgtcgccattgatgtcgccgatgtggttctagtcgaaaatgacctttcacgtctagcattggcccatcaagtttcaactaaaatgaatcgcattgtgatcgagaacctgctactctccatggctgttgttgtcatgctggttgtcctaaacgtcttgcaactcaccaacattgcttggggcgtcatgttccacgaaggcagcacgctgattgtcatcttaaatggcctacgcttgttaattccgcagagagcttaagggaaaactgccgacatccgccctcagtgaaaagtgcctttcgataccaaagtctgttaaaatgggccataagtatcttaaggagcgcagtgctatgacaactaatgatgttcgtaatgcggacatgaatgagaacgcggtgcctagtgacgccgaattgcgggatgtgcttgatgtgtttaaaaccatgagtgacccgacccgcatgcggattattcttgctattgccacggggccaattacggtcaccgatctggccgccatgctcgacctcggtcagtcagcggtttcccaccaacttcgcctgctcaaacaagcgcggttggttgtgggggatcgctccggcaaacagatttattatcatttggtggatgaccatgttttggaaatctacgcgctgacgaaagcgcacattgaagaaaagcagcatggacaagaaaattagtcattgcttattttaaaagcacacaaaaaccaccagtccgaatttgaaacggatcggtggttttttggtaaacaaagcacgcattatcatgcaatctttaaccaacgaaagacagcaactttaaggaaatcaagcacgattgtggctgccagtgtcagtagcagaatggtgactaaaagcggtgagctgatggccggcatgagccagccagtcaaggctaacagcgcaaagatgacaattgtgaaaagattgacagctagcagtgtgcggcttggccaagatgtccaaaagtggctccgttcccggacgatcagcagccggaactgggagttgaagaccaaaccaattaaaacagcggtttgcaagactggcaagctgaggtggaacagatttagccctaaccaaacgatcacgaggtcgactaaggcaaaccacaagcccaaaacgccggaagccgcggttaacgggccgagtcgccattgattaggaccggcagttgactggacattatcggtagcgatggacatggtcgcaaagtcattggcgaacacgagcagcgacatccccagcagcgacactaggctgacttttaaccagaagaagccgagtgtaaacaagataatgatctcaatgactttggtgattttgttgatgacccaagtcagcatacgctggtaagtttggcgactggtcgtgatcgcagcgatgatgtcatgcaagcccgggtgcgtcaaaatgatgctagctgaagccttggcaacatcactggcgctgctgacggcggtccctaactctgcctgtttcagcgcaggggcatcgtttaccccgtcaccggtcatgccaacgagatggccatcttcttgtaacaacttaacgatttgatacttgtcatctggaaaaacattggcaaacccgtcactttcatgaatcaattgaattttatcggctgcggtgccggttttcaaagctttggctggtagaattttggtgccgatgccaacttgctcggcaacatcacgggcaatcggtacactgtcaccggtgatcatcatcggcttgatacctaagttttttagccgtgcaagcatggatgctgaatccgctcgcggcggatcggcgattgccaaaacgccgactaacgccatttgcgaatcgacgacgcttgcgacagctagggaacgataaccttttttggcgttggcggttgctagttgttgaatagcagcgctggcaggcgcagtgtcagcaggatgctgcttggcgtataacgccagaatcgtcggaacagcacctttgatgacccgcatttgccggtgatcagtggttgtgatgaccgcctcggtgcgcttggtggcaaaatcgaacggcgtgaactgctgccgtttagagaaatcgaggggatgcttgatttcggcggcatagttgagcaccgcctggtcaatcgcatccggatgttcttgatctgccgctaaccctgcagcatccaacagttgctcggcagtgtagccggtgagcggttggcaagcaatgatcgacaatttgttttgggtgatggtgccggttttatcaaaacagaaaatatcgattgaagcagcgtcttccaagctcgtcaagcgactgacgatgatgtcttttttggaaagtgccattgccccgacagcctgaacaatggttaggacagcaggcaaggcgactggcacggagccaatcaggaaaatgagcacgaaggacagaataaaaaccggactttcatgcaggtaaaggccgtaaatggcgacaatgaccgatgcggcaatgccaagatagagcatataacggacaatggcgagcatcagttcttcttgttttgactttggcttggcggttttcaccaacgtcaccgtttgaccgaagtaagtcgttgtgccggtgtttaagacgacggcctgaacttcgccgcttttgacaatgctgccagagtaaagcaggtcgccagcactagcagtagctggcagcgattcgccggtcagggcggactgatcgacggtgacattgccagcgataatcgcaagatcagctgggacaatggcgccaattttcagttgcacgatatcgccaggcacaacttggctagcagcgagtgcttgccaagcctgatcgcggcgaacagtggccataatctccagcttcttttttaaaagggcaaccgctttttgcgaattgttcgactggacaaagccaatcaccgcattaatcgtcagcaatacgaagatgatgatgctttcagtgtcatggcctaaaatcaaggtcagtacaatcgccaattccaacaaccacggcattggaccccaatagcgctttaagaaatcaagcaagttattgcgcttttgctcaggaatcgcattcggaccatactgagctagtcgctttttagcttcattactcgtgagaccatccgttgtcgtgttgagttgctttaacactgctgcctgacttttatcttgataactgcgagtatctgcaagcattcaatcatcccatcctgaatcaaaacattaacgacaaaattcttagctggtgcgaaacagttcatggatctcgtcggcatgactgaccaacttatcagctgcttcatcacacgcttgtgactcaagtgtaacgcgtggtgagcaatataaaaaatacatattcgaggtactatccatacaatttgtgtatagtggagctgaaggattgcgaagctgacgattaaaaatgaagggatcaatcgcgatgaatctcaagcaaattacctattttttagcggtagcagaggctggccagatgactgcggcggcgaaacaattgcacatggcgcagccgccgttgagttatcaattgaaagcacttgaagctgaactgggtgtacgcctgtttgaacgcgggtcgcgcggtgtccgactcactggtagcggccaacagtttatgacatacgcacaacagatcgttgagacggttgcggcagctgagaacgcagcgcggcgtagcggtgaaggtgagattggcacactggcgctgggactgacttcttcggccggtgatgtcctgccgaagcaaaaattgcaggcctttaatcgccgctatccgcaagtcgagtttgcgctttatgaggacaacacttatggcatcctcgacaagttacgccgcaacattctggatttggccatcgtccgaacgccatttaatgatgacggtctagcttcatgtcgcctaagcagtgaccacatgatcgccgttgctgccgcgtcgcagcccttgccagccacgctaaccattcccgacctcaagcagcagccgctgattgtgtatcgccggtttagttcgctattcaaaaccactttcgccgagtatggcatcacaccgataattgctgtgttgtgtgatgacgcgcgcacggcgttgcattgggcccagatggggatgggggtggcgttggtaccggcgaccatggccgctttggcgagtcagcaaagtcaccttgccgtgattgattatgagccgtggataacgcacatgacgctcgtttggcagcctgaggcgttgcacaatccattggtggcaagatttgtggggcaactttcgggtggaaaatcggaaaagcattcaaaataaggctcgactagctttgtaggaagaattctgagccgtgccaaactctgcaatctccggccagctggggctggaacgctgtgacggcgcttcgagcccaaaaaccggtctcgaagtcgcctaacaacatcagcgacaaagcccggtcgctgtgttgtttgcacggctgagccccatctggcctacgattgctccgccttggcactgggatctttaaatccctatgaattatccataaaagggccaacaattctgaggcaaaaattgttggtccttttatggatgtgaatgatgtccaaatatctttgcattttttgacgaattacaaatgcttgttttgttgagatgaattatgagtatcccaacagttgatttaacgatgggtaagttaacaaccactcgatatacttacccatattgagccgctacaatgataagtgaaaagagggaacaagatggaaattaatgtcggtgctgtgatcagtgctaatcgcaagcaaaaaggcatcacccagcaagctttggcagattttgtcggtgtttccaaagcctcggtttcaaaatgggagacagggcaaagctatccggatattacgttgttgccgattctggccgcttattttgacgttagcatcgacaagctgatggcttatgatgcgcaactgagcagcacggaaattcgtcgcatctatacgtcaatgaagcaggcctttgaaactcaaccgggagacgcggtactgaaatcaattcgcaacttgattcggcggtattacgcctgctatccatttttgctgcaaatggggctgctgattttgaatcattacgatcttttaccaggagcgtcacaaaccgcgaaagttactgaatatgtgaatgaggcccgcctgttgtttgtccgtgtgcggcaaaatagccaagaggcgcagttaacggccaaggcggtcgaactggaaggctatagtctgcttttgctccaacgccccgatgatgtgttagcgttgctgggcgaatatgtgccagaacaactgcctgcagacagtttaatcgccggtgcttttcagcaaaaaggcgacttgcagcgtgccattgcgaccagtcaaagcggcttgatgcaggacttgagcatcatcatgagtcaactgactaattacatgaccttgctaaatgatgatcctaaccgattggctgcgacgtatcaacgtgggcaagcgattgccaaggcttttgatctagcaacactcaatccggcagtctggctcaatttccaactagctgccttgaatggctttgcgcaacaggataaaacggatgaagccgtggcccttttgcaggagttcacgcatgttttgatggcaacaaaaatgccattgacgctgcatggcgatgcttactttgatgccattgagccatggctagaacaactggacctaggtagccaatcaccgcgggttagtggtcaagccaaacaggttctggctgatttcgtcttgcaaaacccggcattggctaagatcagaacactgtcagaagtacaaccgctgttggctgagttaaagcaagtgagcgggcatcgctagaactcgtatatacgggcattcagaatctcaataatttaaatcaaagcaaaccttggaggaaagaaaatgaataccaattggcaactatttgcagactactggccatttttagtgccactgatcattttagaatttggcttgatgatcgctgcagtgattcatatcctgcgccatcagcattatcggttcggcaatcgcctattgtggctgttgttcgtgattttcattcagatcattggtccgattgtgtactttgtctttggacgggaggatgaaaattgaacatcctaactttgcaacatgtcagcaagcattttggtagcaagcaagtgctgcaagatctgaatctgactgtgccggctgggtcgatttatggctttgttggcgaaaatggtgccgggaaaaccacgactatgaaattgattctaggcttggatcaagccagcgccggagccattgaagtcgctggtcagcctgtgcattttggtgaaacggagacgaatcggcagacagggtatctgcctgatgtgccggctttttatgggtacatgacggcaccagaatacttgaaattatgcggtcagctgacaggtttgcgcggcgctgaattgcagtcgcgggtggctgccatgttgatccaagtcggcttggtagatgccaagcaccgtatcagtggcttttcgcgggggatgcgccagcgcttggggattgcgcaggccttactcaacaccccgaaactcttgatttgtgatgaaccgaccagcgcgcttgatccacagggtcgcacggattttttacagttattggctagtctgcgtggtcagactacgattctgttttcaacgcatattctgagtgatgtggagcggatttgcgaccatgtcgggattctacatcatggccgtctacaagtgagtgcgccattggacgatctgaagcaacagtatgctaaaaaccagattgccttgtcgtttgcgacgactgcccaagcgcaacaagccgcgcatttgttggcaaccttgcagcagcagggccagctgacgcaccttgagcaacaaaaaaacagtcttcaagcagcatacaccggtacctatgctgccgcggctgatcgcgtcctcaccatgttgcttgaagccaaactcattccgatcacgcttgcccggcaagaagccaacttggaacagattttcatggaggtgacgcgatgaacgcagcgattattttcaccaaaaaagaactgcttgaaagctggcggacgcaccgcttgttgattttgacggttgttttcctcattttcggcattttgagtccgctgatcgccaaactcatgccggaactgttaaaaggcggtcttggcggcattaaggtggcggtccctaaaccgacttcgctggatgcatggacccaatattacaagaacatcacccagatgggcatatacgtgttcgccctcatgcttggcggttgtgtgagtcaggagattcaacaaggcacactcgttaacttggtcaccaaaggcttgccgcgctggacggtcattgtgggcaaagcggttgtcgggatgttgctctggatctggatcaccagcctcgcctttttggtaacgtgggcttacaccgcgtactactttcctgatacgcgcagcccacatgtggtactcgcgttcttaccattattagtctttggcttattcttcctcagcctgatcgtgtttggctccacactagcaacgaataattatggcggtttgctgctgacgattgtggtgatggcactgttgtatttggcacaaatggtcaaaagttggcaacatgctaatccggttgccctcattggcgacaatatgaaaatccttgtcaacagtgatgcgctaacgaaattgatgccggccatggtcattgccgtcgttgctgccgttgttttatttttcgcggcgatcaagctgctggatcgaaaaaagctttaaaaaattagccgaatttttgttgattaaactcaaacttcaacaaaaatatcggttatttttgggctatgatcaaacgatttttgaaaaagcagaagtcgtgttcacatgcgcaaacgttataacagtcgggcttgccgtcattatcgttaagatgtgtcgtgaacaaccaaataatgcaaaacacactatatggtgtatacagataataattacccacaaaatttggtagatatcccgttacttttgacgctgagtcttgtatactagatacattgttacaagcacttcaagttaacgtaatgggggattagccatgatcgaattttatacacaaatcaagaaacgagacgggcgcattgttgattttgatgcatccaagatcagcactgcaatcacgaaggcggcagaaagtgtggcaaaactggcaccgagtgacgtgctgacgatcgatcacttgacggatacggtcacggctaagattcgcgatcgctaccacgatgacgtggaaatcgcagagatccaaacagtggttgagcagaccttgatcgctgcagaaaagtataactgggctgaagcgtatactgagtatcgcttgaagcgtgatttagcccgcaaacagaagcaagatgttaattataacgtctcgcgcctagtgaatcgcgacgaaagcgttgttaacgaaaatgccaataaggacagccgggtcttttcaacccagcgggatctaactgcaggcgcagtggccaaggcaattggcctgaaaatgctgccgcctgctgttgccaacgcgcatttacgtggcgatattcattggcatgatcttgactacaccccgtttatggccgaaaccaactgttgtctgattgattttgactacatgttgaaccatggcttcagcattggcaatgccgaagttgaaccggcccattcgattcaagttgctgtgacgcaaatgacccagatcatcgctaatgtggcctccagtcaatacggcggctgctccagcgatcgaacagatcaggtcttggcgccattcgccgagaaaaactatcaaaaacatttgcgtgaattcggcagcgtgattgatgatccggctaagctggaagcactggctgtgaagcagactaagaaggatatttatgatgccttgcaaactttggaatatcaggtgaacaccctttattccacccaaggccagacgccatttgtcacagtcggcttcggtttggggaccagttggattgaacgcgagatccaaaaagacatcctgaaaatccgaattctaggtctgggtaaagaacggcggacagccatcttcccgaaattggtctttactttgaaacgcggtttgaacctgaaaccagaagatccaaactatgatatcaaacaattggcgatcgaatgtgccaccaaacggatgtatcctgatgtcgtttcctatgacaccatcaagcgattgaccggttccttcaaagcaccaatgggctgccgtagcttcctgcagggttggactgatccaaagacaggcaaagaagtgaacgctgggcggatgaatcttggtgttatcacggtcaacttgccgcggattgcaatggaagccaatggcgacaaggcgaaattctggaagatttttgaagaacggatgcgcatctgtaaggaaggcctgctctataaggttgaacgcaccaaacaagcaacgccagaaagcgcaccgatcctctacaagtatggggcctttggtcacaagctggctgacaccgacagcattgacgatcttttcaaaaatgggcgggcaactgtttcactaggctatattggtttatatgaagtcggtactgttttctacggctctgcatgggaaaagaatcccgatgccaaggcattctcagtttcaatcgtgaaggctttggacgatcactgcaaggcttgggaaaaacaatatggctaccacttctcggtttatggcacgccaagcgaatcgctaactgacaccttctgccgagcagatacgaagaaattcggtatcgtgaaggacattacggacaaggaatactataccaacagtttccactacgatgtgcgcaaatcaccgaccccatttgagaaacttgattttgaaaaggattatccgcaatacagtgccggtggcttcatccattattgtgaatacccgaacctgaagcagaacccaaaggcactggaagccgtttgggactatgcgtatgacaagatcggctatctcggcaccaacacgccaatcgatcaatgcttcaagtgcgggttcaaaggtgagttcaccgcaacggccaaaggctatcaatgcccagaatgcggtaaccatgatccagccacttgcgatgtcgtcaagcgcctttgtggctacctcggcaacccgaacaagcggccaatggttcacggtcgtcaggaagaaattattcaccggaagaaacatatcacgtttagcctgaatcaagtggctaatcggcgagacaagtaagccttagcgaatgctcaggttgggatagtcgcgtaacgaaaaaaatcgtccttcgtgggcgatttttttcgtggttttgtatcatgaaccttcctcgaatattagactttaacctatcgtattttgagctagacggtttttattctgttagggcgcgtgtacaattcaaatcaaaagttgtgtctaaatgaagcatgttcctgtggtgacaggttggaggtgcgccatgatcgcagagatatttaccgcaaaacaatggcaaacagcagagctacggagagggtctatcgtgggtgatcttttgcgaggatttagcgagcatgttgatgacgtggccatactggtttagtcatgaggatcgtaaagaagccactgagcgttatcaacagcacttgaagatcaacatcttgaaccgcgataaggacgatgcctatcaataaaaagatcaaaccgagcacagaaaagccgccagcaatcagacttcgactcaaaaccgaccagtcagcaaaaatgtccaccgattttggactgagcatataactaaaaagaaacagaaccgccacataaggccaccaaatcagctgtgcaagccattgtggaaagaatccaaataaggttgtggctgccatccctgacatcatggcaacaacagtcgtcatgaccgccatgatcatttgatggcgacttattttgctatcatagatcagcttttcatttagttttggatcgtcaagaatcaacgtatcaagagagacctcaaaaattctggcaatacgcgtcaccatttctagatccggcaaattgcggtcattttcccagttggagacagtatggcgcgaaacgtgaagctgttccgctaagttaacctgcgtcatctggtgtgccatgcggatctgatgaagctgctttgaaaaattcatgctactcacctcgcttgggcttattgtggcaaagatggatggcggtggcaaggtagcggggcggataaagaggcgcgttattcgagactgggtcattacccgggaaatagtgctggaagaagtcgggcaaacgaacccacattcgttcttttagcttccggtataaaacattggtgtccgatggttttaagaattgcaacctttacgtaaaggtgtaccctattgtcgttgatataattgatgaatatcattaattacataataagtgtttcactggttgtttaaaaaagactttgaatttagttagatgaataaggagacggtcaaatgacacttgatatgaatgttatggctttctggcaaaataagttaaaggctatcggtccgcggctaacagctactgacagtcacgccaaatttattgagttattgcaagacgaaattaagaatcttggttttaacactatcgaatttccttttaaaattaatagatgtcttcaaagtagctgttctcttgagaatgattcaacaaaagaaaagataccaaatttaggaccagttccatattctggaatcaccaaagaaatgggtgtgaaaggagaaattagattctttcaatcaaaacacgatgtgaagatgaagggtaaagtggtcgttattaaagtgaaaaactttacgatccctaagcttttattaatgcatcaggttgccaagtaccctcggcatactcacattggatttagcataagacacccattagttgcagccacattgaccttaggtaaaattcaagccgccaaagataaaggtgcagtcggcgttattctggtttgggaacacatcagtgaggatctcgctaaccgcgaagttctaccttttactaatagttatctggggattccttctgtttgggtatatcaaacccagctggaagccttgaagcgatgtcgtgatagaaaggaaccagtaagactaacactaacgggacaatatgagacaaatgtaacaacgaaatcatttgctgttcttgttccgggggaaaatcggggcaaacaaatccttataaatacacatacggatgggccaaacgatatagaagaaaatggggcaattgcattgctcactgtcttacatgccattaaacatgacaaccttaaatttaaaaatacacttgtgtttggatttgtgagtggtcattttcaaattccacaaagcggaattgaaggaaggcaagccacttcgcgatttctgcgtgatttaagcatgtatgaaactagtcagcatcttgaaatgaagaaggctttaggcctaaccgttgaacacttagggggccttgattatgttgatagccaaaaggaaaacaagcttattgcgactgaattatatgatcctttgtatgtatatgcttcgactaaagaaaacagggatttggttttgaagagtttaagtggtaccaatgttagtggaagatatcaaatcctgaagccacgaaaaaatgcctattttggagagggccaacccttgtaccaagacggatggccaacaatttcattcattggcatgccgcttgcactttgccagatggcatctccaataactgaaccagatattaagagtatgtttgaccaaacgaagttgatttttcaaatactagtcgcaagtgatcatcagttttaaatcaattgcgcttatattttagaatgataacttaagctatcgaaccaatgactgactattgatcctgttgatagctgttgttagtatcgcacccggatttttaaagttaggaatacgagaccctgcttttaatctttgttaggaaagggaatcatattaatgaaaatagcagcattatatgatattcacggaaattatcctgctttgaaagaggttttaaaacaggtaaagaaactgtctccagacttagttgttttgggaggtgatctgatcgcgggacctatgcctttggaaacgttgtcgttattaaagcgcgtttccaccacattcaaaactgtgggaattatgggaaacaacgatcaagatatcgttgatatttatgcaaaaaaaagagttggactatctagaaaggcaactgagcaattgacttggatagcaaatcaattgagctataagcaagtgtctttcctaagaaacttacttcccagcctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccgttcattcgggtgataggcgtggcaaaagtaaaccggtatccgatagcgctttgtaagcgcctgatcgcaggaaaactctttaccgtgatcaaccgtcactgatcgaaccggacccggaaagtccaccatcagtcttgcaaatcccttgagaacagcattttgtgataagttttcaagcttagttgtcgccattaaacgtgtcacccgatcgacaatggtcaaaacagcagcctttgacccgcgaccaccgcgaactgtatccatctctaaatgtcctttttcggttcgccgattagctgactcactgcgaatctcaattgaggtgcctactgcttggttatagcgcgaccgaaggtcttgtcttcttttatgacgtttaccgtgatcaaagagttggcttggctgaaaatcgacttgtctttgataaatccagtggtaaatcgtgtgtggcgcacagtgaacggcataaccgaccatttcaggggaccaacctaggtttagcttctcagttaccatccgcttcaacttaggcgttaaaatcgagtgccgaccacaacgatgccgacaagtatcggcatgatcctgagctataatggcgcagtaatcaccttcagggcaacggtgaagctcatgcctaatagaaatacgagagcggcctaaggtcgcggcgatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggccagtattagtattggaaattatttcttttgtcatgctgtgaaaaatgataacaccactgttttttctccacgacaaaataaagcctacatagaggctttatttaaaggagttcaagaatcgtatattatttgtggacatactcatatacagtttgaattgtccttgcctaataaaaagattatcaacgcaggcagcataggtatgccattctcaaaccaatttggcgcgcaatggttgtggctggacgataacagaattgaatataaaagaaccattttcaatcaacaagctgcaatacaattgattagtcagactgaataccccttcaagaacgaatttattgcgaataatcttcgaagtacaatatccttgagtcaaggatatagcatcttaaatacactaattcgcgcccaaaatgcgcaacacgatttaagttaatacgtaaaagcatctggaattatttctcaattaagtcgcttgatgttaaagatcaatgagtatgaattccctgttaaccgccttagtgaattcgaaacagattgcctaggcctctttaaagtcatgggtaacgactgaaaatactattgagggggtattgtctatgcaacttggcagctaagcggtgatttcaccacagaaataacgttcggtggcatcgagattggacacgtattaccaatagtgtccttggttaaacagatgttgtggatcatactttgttataagttttctcagtttgcgacctgtttcttccggccaaatacgttgactttcttctatcgatagatcacttgagtaggaactatagacacccgtccctaaatcttgtagtgggccaaaaacctccttagcatgaggctctgtgtccttttgcaaccacatagctaagaatactttcgcttttcgatcatgccatgcagtttcatcagcattaatggtatttagcgggccgtcaattgctctcatttcgataccaatgattcctggagaaacaagtattttgctgataatatcgccaatattagcattcatggcatccagtaaaatattttttacgaaaacaggttgttgtccagaatgcgggatatgaggagccttgaccaattcagcatagctttttgtctctaattgatgtttattcacttcagaaaggcttagagctgatttaaacaaggctttcgcatcagaatttatagaacctgcccaaaaattactagcatttatgtgaacagtatttctattttcggcagtcaacatgagattgctgctcattttactagatgcgtgagttatccaactttgccattgctgaatgaactttgtcaaattactcgtttgggattcaatggtttgtacagtaaatggtagcgaaatatcggatttctcttcaaccaacttacttgctttaaaagtgaacgctgtaaccattcctaactgtgaatttccacctcgaataccccaaaaaagatcaggatacttttgatgatcagtcacacggatctcaccatcagcggttactagtctagcgctgacaatatgatcgattgtcaaccctagacgacgaacgagtaagccaatgccaccacctgtggcgagtccaccaacacctgtatcaccaaaatcaccacttgagatgattaaattaaacggacgtaaagcctcggcaacatctccccagactgcgcctgcttgaatctgaaccaatccctgttccgcgtcagtgacagtaacgctatttaactgtgaaatatctaaaatgataccgtcatcattcaccgaagccattgaaatgccatgaccgccgctacgaaatgaaaacggaatactgtggctaacactttctctaatttttttgacgtattgaatgctagcaatgacatcacgctctgtcgttgcccttaagattagctttggacgaccggtgacaaaatagtttgaacacataagttcatagtcatcagaagtgggatcaattgcgatcttctttagtgctactggtaacttaggccacgtggcgttaacatcgttattcatcaaattcctcctaaaaattttttcatggttggtaaaaattgctcttacagatgctaaaaaatgattcatcatcagcgacagtcgtctatgttagaaaacgcctttattaggctctgctgctaaacattctcattctagtatactttttgacgagaagtgaaaggaagagacatgaagacttcaaaaacataaaaactcttaccctagcgtgaacgtggacttcacaaaaaatcttgatgtttgtttatcagcagcatatgaagaccaacaccttgaaccgcgatgagaacgatgcttacagtagaaagatcaggctaagcacagacagatcgccaagtaaggatcaaagaaatttgttctggtatactaaccagaagggatagaatgccatgaaaattgtacttatcatttgcatcgtcatcgcgatagctgctgggtatgttgccaataagaggcggcaaagacaatgataacagtttcaatttctttgcttgtcatacctcaagcttccgtgctatactccatgacggtgccaaaccacggtgagttcgtaacgatcggcgcgtaagcgttcagaaggtcgaagcggctcgccatttttttgtcttcatttggtacaaatgttggtggtgaaaggcggatctgacggacaagaacaaccttcttggctgctaagaaggttgtcagaagcatagataaatgtatcaaggcaaacacaagcgcattaatcctgacgcttactatcctgagccttcattttctgcatctcccgcttttgcttacttaattttgattgccgtccgccttcccacaggctaatcaaagtcaaaagaccaatgatgggcatagcaatatctctaaaagagagttgaagcaaaccgtttgctaaaaagtagatgtcggccacaataaccgcgattggcagaatggcacctagcagtttattttcaatgtagccaaaaaaggtttgaagagaaatgacgatgacgatgatcagtgtttcaatcattggtagtctccttgtatttttgaatgatttcttgggccaaggctaaatcgagtttgtcgtcaatgaccatctgcatgatgctaacctgaaacttgtttttctgatccaattcggccgcttttagcttgcgaatgacgcgatccaaacgcagccggatggttgggtaagagaccgagtacttttcagaaagcttcttgagtgaaccggaagataaaacgaattgtctgacaaactcctgatcgtcctcatctagcaacaaaattggattcaatgtcacgaccaaccgcccccgactttaactttgttgatataattttaacaaaatgaaagccgggggttccaataaacagcttgggaacggactgttactcatatgccacaacaaaaaaccacagcccatcttcacaagcggctgtggcgaaataaattagcattttgatataagcggtgttggtaagttgcgtttcaggagattggttctgtgtttaagtttttcgctgacgagcgggcggttagggcttcccaatcgactaatggttgttgtacaaccgcggctaggatcagaatgagcgaccatgtgaggatcagactcatggtgacatcaccggtgaaatgggcgaggatgcgcacgcgggtgtaggccatgacggcgccgtaagcgaaggtgagccagaagaccagccgctggcgttttggcttgtcacgatcgacgaaccatgtcaaagttagcaaggtcgcggcggtttgggtatgaccagatgggaagctcatgtgaccattggcgccgtttggctggaaccagcttgtgaagtgggtcggattgccgtttaattcataaggacggaagcggccccagaaagttttcatggcattgacgatttggtcagatagcaggcagaccaaggtggcgacaacagccattttcaataagtaatgaagctgctcatcggttttttgggcgagccagtactgactgccgatgaacacgacgaggtagaggatgaggaacaaaatgatactggtggcacccggcagtgttagcttgctgccgtcagagttagccatgcccattggcttgccagcgttgatatcattcagcgaggtgatcaccatggtcatggcatacttgaggtagccggcccaaagttcccaaccagcgtagatgacactaccgatcaccattaaggtgcgggtataccacgccagctgttgtgaacgaatggcataatgacaaacaatgttgcaactgagcatgatgatcaacggtgcggtccacagcccaacgtcttggaacaaagtggcgaatgggtcgttcatatcaccgatggtttgcgagatttgccagtcaaaaccagcagcggcagctaacaataaaagcagtacaccagcaacgatcaagaaaatatgtttgcgaatcggagcattcaatttttgcgtttggtccatagcctttccctccttagacgcgttcgcagtcgcagaaacttccgtgtaaggaccttgaagcaaagggaccaaaagagactttcctttcacttcaaggccactgacacttcaatttctcagcgctcctgctctcgctctttgaaaatagcacatagtttacagaaaaggtcgggatttacggtacctgtacgcaacatttaagtggtcgatacgaagtttacaacttatcagcaaaataaggttcatctaccgtaacttgacgctgatcgaaatcgaccgtcgtttgcaggccgtatggcaggacggttcgcggataggcgtggccaaaattcaggttgtacagaatcggcgtcttgtatggttgggtgacatcaagcagcacctgctggtaaacgtcaaagtaagtttcattttggggcttgccaacgagaatcgccttcacttgtgcaagaacgccatgttcatcaagatgttctaaataggtgcggtaagttacgggggttattttgtcttctgatgtttcaatgaaaaggatcttgttggtccagtcttgcgggaagagctggtactttttggccacttctggttcgtcctgatagcgaaccgggtagattaagtcgtggagactatcgagacagccaccaagtaaggtgccagtgacccggccttgaccccgcagcgcaaggtagccatgctgttctttgtgtgattttcgtggtacccctaactgactttctgaaaagtccgtgcgttcgtcgtaccaagtcgggctggaactaatcgccgttgtcgccggatttttgaaataatgctgaaaactggcggcggtgtacggcaacatgtgcgtgtctaattcagctagatcatttaaaaaattaggcccataaaagctagtcatgcctaattgataaaacatgagatggtcaatggtcgtgtcggaaaaaccagtgaacagtttgggatgatcagcgactgcttgcgtgaaagccggatcatctagcaggtaagggatgattcggtaagtatcatcgccgccgatggcacagatgatacctttgatgctcgggtcaaggaaagcggcttttaaatctgctgcgcgtgcttctggatgggctttgagataggcttggccgcgtaaggcgtttggcataaagcgcggttccagcttcatggctttcaatcgctcagtcccaagttgaagctgatgggctgcaaagctttcacctagtgttccggcgctgaggctgacaatggcaacttgatcatgtggctgtaatgcttgcggttttatcataaagatctccctgctttctcatacaatgcattaattatctattgaacatgcaggaaacgcaagcgggcaaagagatgacaccatcgtcgttctaaccgtaaaccggttgcttgtttttccggctggcaacctgttacgatcgaatagaagacctatcaggaagtgttggttaattaaactgtgcgatttttaacaagacacagtatcagggggaaagcgatatgtataccatccaagcgactgccacgattactgggcgtggcacagtgatcacgattgcgcctccggttgaacgcattcagccgggcgatccgatccgccttaatggcacgacaacaggtaaagtctgtgcgattgagaagcggcaacatccgcaccatactgacgaagtcccgtgtctcgggttgctcgtcacggcacctgtcaaagtcggggatacaattgaatttccgcagtcgccacggtggttgtgaactgtaggcgatacgcgctcccagttgcagaattctgctcgtactcaaagaaaaagtcgctatctgaatcgtcaacggcatcacgttgatttcagatagcgactttttatggttactttgagcaaaatgaagatatattttggccgttgtggcttacttcgttaagagtccagcctcggtcatgccgtcagcgtagagcttgagcttgccgttgacaatatccatcaccaaatcgccgtagtcaacaccgtctgcttcggcttcttgcggcaacagtgacagtggtgtcatccccggcaggttgttggcttcaatgacccaaacacctttttcgttggcgaagaagtcgattcggccgtaattttgcaggcccagaacatccatcgtttggacggcaacatctttcatagcctgatggacatcttcatcgagatcctttggcggggtgatgaagtcggtgtagccggcttggaatttatgcttgaaatcataccaaccagaacgcaccttgatttcaatggccgagtaagcgtggccattgacaacgcctaacgagaattcgcgacctggggtgaactcttcaacaatggcactgttgtcgaagcggaaaacatcttcaagaccactttcgagttcttcctgattatgaataatatgtgtcccaacgctggaaccgccggatgttggcttgacaacaactggaaaatcaaacgggaccgtttgttttggcccttgatcgcgcttgaattccttgaatcctgaagtctgaatgccatgatacaacatgacttccttactgaaaaccttgttcatggtgatgcctgaagccagcgggccagagccagtatacttgaccccgttgatgtcaaacacagcctgaaccttaccgttttcgccatcgccaccatgcaaagcgaggaaaacaatgtccgctgctttgcagatcgccataacattgggaccaaatagctgggtgctgccatctggtcgtaacttattgatgtcttcatcagtcagaatcgcatctgaaatgttcagatccttgctggtgttggcgtcatcaaaaacctgttcgaccgtcttcccttcgaggtcgtagccaagaaacaggtcaataaaggtggcctgctgccctttttgccgcaaggcgttcgtgatccggcagccgctagaaatggacacattgcgctccgtgctccggccgcctgctaaaacgacaattttcatgtgatagtacctccgcgtattatccgagtttgatagaaacctcagtttagcacaatctgggctcatcggcgataaagatgctaaaaaatggtgtaatattaagaaggcttttaaaccctctgccatggttgtgaacgcgctttctccaaacagcgcagataaggagtcaaagaatgcaatacacacggttagcaatgcccaatcacgcctattttatcgtggccgatcaagggaaactggccttcgtcgggtcaccggatgcgccgcttagcgaggcggctgattatgtcagcggttcacttgaatttaatcaagaagagatgttgccgtttaaaaacgccattgatgattatcttactggcaaggagcaaaccatcacaataccggtgacttaccatgggacaccgttgcaagaagccgtctggcagtatctgcaaacgattccttatggagagacccgaacgtacgcacaggtggcagccgcagtcggtcatccgcacgccttccaagcagtcggctctgcggtcgggaagaatcccgttatgatcgctgtgccttgtcatcgcgtcctgcgcaaagatggtggtttgggtggctttcgtggcggtttgccaatgaagcgcgacttgttggcacttgaacaagggcagcggccaattttttaaagatgctttttcacagaggcatcttgtatactggtgagtggacaaattggaaaggaagtttaacacatgaagattattgcttacggtgcacgcgttgacgagattcaatatttcaagcaatgggccaaggatacaggcaacacacttgaataccatacagaatttctcgatgaaaacaccgttgaatgggctaaagggtttgatggcatcaattcattgcagacaacgccatatgcagccggcgtttttgaaaaaatgcacgcgtatggtatcaagttcttgacgattcggaatgtgggtacggataacattgatatgactgccatgaagcaatacggcattcgtttgagcaatgtaccggcttattcgccagcagcgattgctgaatttgctttgaccgatactttgtacttgctacgtaatatgggtaaagtacaggcgcaactacaggcgggcgattatgaaaaagcgggcaccttcatcggtaaggaactcggtcagcaaaccgttggcgtgatgggcaccggtcatattggacaggttgctatcaaactgttcaaaggctttggcgccaaagtgattgcttacgatccttatccaatgaagggcgatcacccagattttgactatgtcagccttgaagacctctttaagcaaagtgatgtcattgatcttcatgttcctgggattgaacaaaatacccacattatcaatgaagcggcatttaatttgatgaaaccgggtgcgattgtgatcaacacggctcggccaaatctgattgacacgcaagccatgctcagcaatcttaagtctggcaagttggccggtgtcgggattgacacctatgaatacgaaaccgaggacttgttgaatctcgccaagcacggcagcttcaaggatccgttgtgggatgagctgttggggatgccaaatgttgtcctcagcccgcacattgcctactacaccgagacggctgtgcataatatggtttacttctcactacaacatctcgttgatttcttgaccaaaggcgaaaccagcacggaagttactggtccagcaaagtagtcaactgaatagcaaaacgtgccctgcctattgacgaatacgttaatggcagagcacgttttttaatattgggattgcttgcttaaaaaatcgaattgccacgaattgccatgatataaacaaacaaggcagcgccattgacgaacaaggagacggcaatgattgaaaaacgaatggtgtacggtctggcgcctatgtcaggatcataaaagcgtgaacggcgtttgccacggtaagagaagaaaaagcctaccagaataacgacaatgatgctctcaacaatcgtgagcaaccaaaaaaccggttgcgttgtactggcagtgaccagaaagtacccgccaagagcgataagatcgagcaggatcgaaatgagaaccatcgtaaattcctcctttaaagtgagcgtgagccagcgcgggtggaaccgaagtgtaagtggccttgggcgtgatgaccgttctttggtcattgcaacgaaggtccttacacgcaggtttcagcgctggcgagcgcgttatggcgagcgtatcgcgagtgggactaagacttgggatgtaaaggctgagccgtcagttttgtgagtacctgaatggtagtttgaacatcttgtggatcaagggtatgaagtacagaggcgagttgagcatttgtgtgatgatgcatttgctgatgtaaggcagcgacttgttgaccaagcggagttagtgcaacaatgtaggccttgcgattgtcgggcaaggataattttgtcagcaagtttaattgaacaaggcgagcaacatagcgtgagactaggccttgtgagaacggaacagcagcggttaaatcctgattgcgcagttgtttgcgactgctttgatccagcgttgtgagtaacgtcaattgggcatgattaaaccgaactgtttgcatttgccggcgagtttcagaggataaagttgccagccaacgatcaaaaagcacttgccacgcttgctcatcagcagctcgagtatgggcattgagcaagcgaatggcttgttgtaattgggtgaaatcagcggccataagtgcctccttttaattacaggtaatatattttgacaacagaagattgtggggctacactctagaatatattacaggtaattaaatttcaagaaactaggtggtcctttgaaagcagcaattgtaactcatttagaccaagcccccatttatggggattttccagcaccgaagccagcgcctaagcaggtattgatcacagttttggccagcagtgtgaatcaacgtgttcgttcgcaggcggatgggtcccattatacccaaacccctgagctcccatttattcccggactcgatggcgttggtcgcaccagtgatgggcaactggtttattttctaacacgcgatccaaaattcggcgctttagctgagcaaacagtgacgcagcaacagctaatgtttccactgccggaagatgctgatcctgcgcaaattgccgcgagtgtgaatccggcaatggcaggctggatggccttgcgcgtcaaagctgggcaggttgttggcaagcgggttcttgttctgggtgcaacgggggcggccggaactgccgctgttcaaattgctaaaacaatgggcgctgcacatgtggcgggggttggtcgaaatcgtgacaagttggcggccttaagcgatcttggtgctgatacgacagtgcagcttggtgacactgctgccttggcggctttaccgccagccgacattgtgcttgattttctatggggcgcacccagcgcaaccgtgatgatgacactgctaaaagcgcggcgtgatcatgctgccaagttgatttggattgagattggtggtgccgctgggccaacattgtccttgccggccgctgctttgcgcagtaccggattaacgttggtcggcagtggccaaggcagtctgacattggctgactatcaacgggaattgcccgctttattcacggctttagccgccggaaagtttgtgacaccgacaactgtcctgccactcagtcaggtgcatgatcactggcaagatcgcggtgcggctcgactcgtgttccaaccttagcccatgcaaaaggcgttctcgtttgtgagaacgccttttgtcatgatcgtggttttcatgattccgaaaaacgcattaagtgaagcgttcaggatgcacattgcacagtgacttaacgaatcagttaaaagaataaggtcaggcaggtaagggcaccgggaattgcttgcacaaagtagatctttttgctaacggtcgcgccgccgtatagacccacgacggtgacaaagccggttaacagccgcaaggtaatcaattgatcagtgccgtgcagcagtattaggctgagcaacatgacaacagcgagagcaccgttatagatgccttgatttttcaatgcaatttgagcattgggttgtttaacaaaagcaagcggcatgctgaagttttcggcctgactttctggtttgccgaacatttccaaagccatgatcgtcaaatgcaataaaccgagcaagccgacaagtaaagtgctgataagtgacacggtgtcacctccgtttctttctaaacgaaactggttcccggtttttctaaacgcgttcgcaggcacagaaacctgcacataaggaccttcaacataaatgaccaaagcccggccatttatgttggaggccgcttatgctccggtttctaaccgggtcagctcacgctctgtgattagatgaacggtcggaattgggctaaggcaaatccagcgactgtcaccaatactaacgctgcaagggtgctccacacaatcggtttgctcaggcgatggtcctttttgccagcgaaggcgatctcgattaagccgatgaggccaatggcgattagaattttaaccaccgtcaacaacggattgcgcgcaaaagcaaagcgcatcaagacaatgccgctcacaatggaaacaagataacaaacgcgggtgatcatcgtccataacataaactggcgagtcttgctaaaaagagcgatccccgctgcaatgattagaactgcccatgaaacaagatgcatccagagccacataaaaatgaccttctttctgtaaacgaatgttgtagtctcatcataccgctttccgaaaagcctgacgagcgtgtttgaaattagggaaaacacgaacattaatcataaaaaaaagaaaaataaacgtattttctattgcaactgtcgtcagtctcgggtacacttttcatattcacagtttaggggagcgtgtcatggaaaacttttttcatttgaaagacaataagaccacgccaatgaccgaggtcatggcaggtctaaccacattttttgcaatgtcatatattttattcgttaatccccaagtcctatcacagacagggatgccggcacaggccgttttcttggcaacgatcattgccagtgcagtcggaacgctggtcatgggtcttttcgctaatgtgccgtacgcgttggcaccaggcatgggactcaatgctttcttcacttatacggttgttttcgcgctgggattcagttggcaagaagccttggcgctggtcttcatttgtggcgtgatcaacattttaatcactgtcaccaaaattcggaaattaatcattgtcgcgattccagaaaccatccagcatgcgattggcggtgggatcggggtcttcgtggcttacattgggatcaagaacgccggcttcttacaatttacttctgaagcttccagcattaacaccatcaacggccaaccgttgaaggcgggcgcactgacgctcaaacatggagttgaatcggttgtttccaacggtggcattgtgccggcactggttaacttcacccaagccggcgctttgctggccctgattggtttgatcatcatggttattctgaacgtcaaaaaagttcccggcgcaattctgatcgggattctgctgacgaccatcattgggattccaatgggcgtgaccaacttgcatctgagcgctgcaaattcctttagcagcacttttgcatcattgcagacaacctttggcgccgctttttccgctaaggggatgggatcgttatttaccagcccagacaaaattgccctgtcaatcatgaccatttttgctttcagtttctccgacattttcgacacattgggaaccttcatcggcacaggccggcgcaccgggattttctcggatgctgacgaacgtgctctggaacaaggttcaggcttctcgtctaaaatggatcgcgccctgtttgcagattcaattgcgacaggtgttggctccatcttcggtaccagtaacgtcacgacctatgttgaaagtgctgccggcatcggtgctggtggccgaactgggctgacttcggttgtcgttgccggcatgttcctgctcagctcagtctttgcgccattcatcgccattgtaccgacccaagctttggcacctgccttgatcttggtcgggatcatgatgatgagcaccttcaaggaaatcgaatgggaagatctttcccaagccgttccggccttcatggcatccatcgtcatgggctttgtctacaacatctcatacgggatcgcggcaggcttcattttctattgcctgatcaagctgatcaccggcaaggttaaggaaatccacccagttttggcaattgtcacaatcgggttcattctgaacttcgtgattctggcatcgctgtaacacacaactaacggctgtcttttaaaagaagctgaaacagacactgccactgcgctgtaaccaaacgcgcaggcggcaatctgtttcagcttctttttgatgggcgactcgtggtatcctcaagctgaggtgagacaagatgacactaaaaacaatttttcatttagatacaactgaacgctggccacacttggcgtccaatcttgacaactatctggcggcggagccagacgcagacatcgaagtgctggtgaatggtgatggcatcaccgtcttttttgaccaaaaggtagccgccttcatcgctgcgcatcctcaggttcacttttttgcctgccacaattccctacagcaacgtcacttggacgaaacaaaattaccggctggcgtaccagtggtgccggtcggggttgttaaactggcacaagctgaggcggcagggtatgggtatattaagccttgatagaacgaaaatgaatgtagtaaaaaagacccagtgaattgatgaacagatattattgattagaaaaccgctcattgaccgggtcggatactaaccctataaaaaatttatgcttttatataaacaaggaggaactctactatgaagaagggtactgcagtaggcatcattctcacggtatttttttgcgtgggaatacttgttactattccagcactgtcgaaacaaacaaatatacaaacctcgcaggaaaagaaggatacaacaacttcacgtgataaagacgctcgggaatcaacatcccaggccgaatcaaaacaaccaacaaagaatgcgattagtgagagcgaagcagggggacctttagattcaagtacggtgtcgagcaaaggcggatttacgattatctatgataaggatggtaatcaagtgccagcgcttgataagtatgggaacgaaatactggttgatgaagtgacgcaaacacctgataattgactccgaaagttagcaatttgttgtcctgctgtctttttttaacaaggctggaaaccaaaaaacaacaaattttcaaaatataaagaggaccactagagccaaatcttgtccctcgtggtcctctttgagttgaatagaaattcgttttatttcatgcggaatctaagtgacgtaattttaacagatatttttaagcaaacgatttcgaaatttcaaataagtaggctctgcataggcttggctgacaggctgttggaaaaaagaattcttatactcagctttgatcgtaccaggatggccattaataacgacaatttgttgaccaagaaaaagcgcctcatcaatatcatgagtgatgataatcatagcattttgagtagcacgccagagatcaaacaatagtgtatgcatctctgcccgtgtatggttatctagagctccaaacgattcatctaacatgagtaacggaggatggttgatgaacgcgcgaacaagggcaacgcgttgtttcagaccacctgagagtgtataaattgggcgattaacataatgagttaatccagctttttctaatagcatggtaaaatcgtctgaagattgatgacgcatttttggaccaaacaaaatgttatcacggacatttaaccaaggataaagagccattgtttgaaaaacaacgccgcgcttccaagatggccctgttattgatttgccgttcatggttaaagttccttgactgggttttagataaccggcgatcaagtttaataatgtggtcttgccaatgcctgaaggacctataatgacagttgttgaattcggacagacagttagactaatgttatgaatagtaggtgacgttccttcgttgtaacagtagtccacatgatttatgtcaagtagtgtcatcattgacctccagaattaagaaagcgaactgtgacaaattgagcacagtccttccggctaattggacgtgacaaggtttgctgttgccacatgaattgagcagtgttaaaaaactgggttctaaaagtgtgggatatgaaggcttcttgttgatgggtgttaagccattgagaagttccaatttgttttttgatcacacttgtaggcatactaagactttttgctgcatcgagatataactcttgtggatcattttcaaattgaagatgaactttattgaggcaagagagaattgttcgaagtatattcggatgcgcatttatgaatgaattcgtggccagtgttacattggctgtaagatacccacgttgcgccattgaacgactgttgatcataactttgccatcggttaatgctgagaggcttggctcccatgtatatgcaccatcaatgtcaccccgttgccatgcagcaacaatttcgggagtttgcatatctaaaactcgaactttaccggtcaaatgatgatgtttcaataacatcattaggctatagtgagacgttgaggcaaaaggtgttgcgatacttttacctttgaaactatcccaattagtaatatgtgcttttcgacgcacggtcaacgcctcgttactaccaataatgtcgttaatccagaccaatttgactggaatccttgcagccatggcaactacagcattagtatggcccatagtcgcaagctgaacagaattggataacagagctttattggcatctacaccagaatcaaatgtgataaactggaccttcatcccataatgccgacatttagcttgaagcattttgcgttcttgtgctacagcaacgtcattagggaccctcaagacaccaatcttaatggttgttggctttgtgttggatgaagagcatcctgtgagaacaagacaacaacacagaaataatagcgcctgtaagggcttaaaatattttgttaacaatggattaccctcttccttgccattgaataaagtgatgactaaattgctttagaaaccagtctaacaacataccggtaattcccatgacaacaatatctacaatcatgacatcagttttgagatagtgagaagcgtcaattaccatccaaccaataccgctggttgaagcgatcatttctgcagatacaatagttgtatacgccataccaactgcagagcgtacaccagtcatgatggcaggtaatgaagcaggaaaaatgactcgaagaaaaatttgccaataattggctcctagtgaagcggcattattgcgatattcaatattaatccctgacacggcatcgtatgcagctagataaattggaggcagcgccgataaaaatagcagcaatacttttgacgcttcaccgattcctagccataagattaatagtgtataatatgccaatggcggtataggtcggagaaactgaataatcggatcgattaaactaccgattgttgtattataagaactaaataatcccaaaggaatgccaacaataatggcactactgacggcaactcccactcgtgtcagtgtgagcaaataatgctgccaaaaaggagtaccgttataaccaaatctaaatagatttaacatggctatccatacatcagtaggggctggtaatagaacacttgacacaagatgagagctggttatacaccaccataatcccaagatgcctactactatgagcgaacgtccactgaggctagataaattttttctaggtgtcatcatgcaaccccccaaagatcaataaacaaaaatatctagaccgtctaagcctagacatctaacttttcttctaaagtaagtcaaagcggtaatttgtaacaattggtctacgattctgagtttgatcttcgaaatattcgaattcacaaaggtctaagaaagaacccgcgatattgtaaatattgtggtatccacgattacccagcgcacgggcaacgttgtaactgcgctgtccactcagacaatgaatgtaaacgggacgatccttgggaatttccttgagatggtctcgaaatacgctcattggaatgttctttgccccgatgatatgaccttccgcgtattcatcaggctcacggacatcgatgatggtggccccagcttcaacaagtgacctaacatctgtgaccatcacctgtttaaactcatcgtttaagatgttagtggcaactagtcctgccatattgacagcattcttggctgtactgaaagttggttgatagcacaactctaatgtttctaaatcttcgacataattgtggttggtaattgctgtagcaataatatcgatttgcttatctacggagctctctccgattgcttgtgcccctaaaatttcaccagatggataagcaaaaattagtttcatatatagtggttttgcacctggaataagcgctaccttatctttgggaattaccattgcggaacgaaaatcgatttctgcatcttggcattgttgtgcagttagtccggtggaggcaacgttcgtattgaagacgggtaaacattgtgatccaatgacaccgcgattacgaatttgccggccataagcgtggtctacagcctgacgagcttgaagctgggcaggaaaagctagatttagtcgagtcggtcggcgtagaaggcgactgtaaacttcaattgcgtcgcccacagcataaacatgtggcaaattggtttgaaatgattggttaacttgaatactgcctgttttaccaagtttaatgccactttttcgtgccagtgtagtatcagccttgacaccaattgccatgataactatgtcactgggcaattcctgtccggaagctagtgtgatgctgtgttttccgatggcagtcaatgtatcgcggacaattaggttgaccttgttatctagtattgttttttgaaccacctgtgccatatcttgatcaattgttgccaagatgtgatctgcgccttcaactaagttaacgtgataaccacccttcactaaattctcggcagtttccacaccgataaagccaccaccgataactgagatgttggagatactgcactttttaagaacatcgcctaaggcttttatgtcgtcaacattacgaatcgtgaaaacattggatccatcaatacccttaattgattttggtaaaattggcactgcacctggggataaaaacaaatcatcatagtgatcgattgcagtttcaccggtttgcatattcttaattgtcacagcccgatttacagcatcaattgagataacttcgtggttaacaatggcatcaatattatattgacgcttgaactgaacagggtccattagcacaatgtcatcggcatttggaatcatacctgataggtgatatggtaatgcacaattggaaaaggatacatttgggcctttttcatacatgataatttttgctgattcatctagtcttcgggctcgtgcagctactgaagcaccacctgcaacaccaccgacaacaataatttttttactcataggtaatatcctccttaaggactttctttggcatgtacatagggcataaatcaagctttccttggaatagcttgattgcaaaggctgcccctaaaacaaggaaaaacataaagatatatccgtgcaatgaaaagttggtgatggaagagtaaagtgctccaatattgcaaccacgcgccatacgtgagcctagtcccatgaacgcaccaccgaatgcatagccgctaaagtctgcccaagtcattttgagattggctttaaaccgacctgccattaagaatgcaattaatgctcccaacacaatgccaatgttacgaattgttccgccatccataagtagtggaccgctcatagcttttgctgtttcatcgaaagctggcgagtggaactgcatgccaaataattggaaaattttttgatcaagagtgacgaagggagttgtaacaccccaagctttgtttgtggtaatcatgatgaaacttgcgacaagggtaatgccgatgccaccagtcaaaaaagaccatcgttcgataaataatttatggtaagttgtccaagaccaccatttgaagtggtgtttttcatcaagtggtattggcttttcatagtctgcccagtctgactttggacttagccaagctccagctgccttttttttattttcataatatttcgttatgaggtaaaggacaaagagaatcgctattgtcagtaaaagtgctccccagtaaccaatgtattgtggtagccaaacattaactccgattttgccaatagttgtattatcaagaatatatccaaaatattggccgggtgcagcgaatagaacaaaaaaaggaaaagcaatccaagcgtggccttcgccttcaccgaagtcggatagcgttccagaagcacaaccgccagccataatcatacccatgccgaaaaggaaagcaccaatgatgactgaaatatttccaattcgaacattttgcgtgccagggattaaagcttgtttggcactggtaatttcccatgctggtatagcaccattacttgctgcgaaccattggataccaaaattaatgagtgcggttgttgccagcataaccagcaacgcaattgttagacttccttctcctcgataaaagattcgcttgacacctccagcaaaaccatatcgtgagcgagtcagagtataaccaatcattaacccagcaaccagagccattggtagtgatcccgctttttgatttaatgtaattgcccaaacaattgttaatataagcacaataaagccaacaattggttgtctcttatctagaccataacgatcaaatcccattgatatcatgaacacccctccatttctgtttacaagtgaactgtataatatttcacaaaataattgaaatacttattcaattccactagtataacttgtagggtatagcgcttttttggggggtagccatggtgaaagatacaacacaacttttgacctatttgcgtactattatttctgccggtagtgtgacggctgcggctaagcgattatatatctcacaaccgtatcttagtcgatttgtcaccgaaaacgaacgccagttaggatatcatttgctagatcgtagtaggagaccgatcgcgttaacctcaatgggagtccaatatgttcgcgccttagaacaattaaataatcagtacaataaattaatgcacgatcttgaaaagatggcagatgtgactcatttacgacttgggatcaatcagtcgatgtcaacaaatgttgcaccgccactactctatcggtaccatcaagttcattcggaaagtcaaatagcatttaccgaaggaatttccagtgaattaggagatttattgttaactgggcgaattgatgctcagttaaggctattgccaatattttcgaatgagattatgtatcatgctatttgcgaattgccagtctatttattggtcaatgatagttcgccactttttacttcaggacgccgagaaattctgacattaccagttaaggcacctcagtttcgtcaagttgattacattacattagattcaggatcgggttttatgaggcaactagatgttttctttgatgaacagagaattcgaccaaagaccatttttaatgtccgtttcattcaaacagctgcaaatttggcctatcatggactaggatgtacttttgtaccacaatattgtttacatcgccatttcgatgcaacaagatgcaatatcatcaaagtacctttaaatcaactctcggttaaggttgtgatggcatatcgccgtgactcaggtatgggagacaaagttaaacaattgattgatgagaccgaattaagtaagctgcttcaagatctttatcaagattgagtatgctaaatcttgataggtttcctttttcaatgatgttatatttttaacaagcaatgaagaatccacttaacgccagcggatcaggtttttacttcttctttctagcagcgagaacaagtaagactgaatatgttactactttaaaaaaacactctgtaatggggcataccaatatttagtcagaatatgatgtttcctctacttcccatccccaagtactgagccgcaatttcagtgagaaaatctacaacctttggagacggtttttgtccaatagctaagggttgcagtcctgttctaatttcgaaggcgattccttcctcgttatcacccttttgtcgtcgagtttcagcgtgtttcaagatttctagttcagatccagttgtagtaggatctgcgatgagttctggaagttgacttaaaattgattttttgcttttcattttgacaatttctttctcgtcattgcacgaaaaaaccgttcgagagtttcagggtgtttatttatggtgaaagacttatgctctttggttaacacttcataaaaactattaaacttcaaaggcgttccgataattgctctattttactatcagcattgatgtgaaatcaattatctcatcttttctttggctttctatcccacgtcatatgatggtctctgtttttactttaagcttaagaataaaagacattttcaccatggtcactctaaagcctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccgttcattcgggtgataggcgtggcaaaagtaaaccggtatccgatagcgctttgtaagcgcctgatcgcaggaaaactctttaccgtgatcaaccgtcactgatcgaaccggacccggaaagtccaccatcagtcttgcaaatcccttgagaacagcattttgtgataagttttcaagcttagttgttgccattaaacgtgtcacccgatcgacaatggtcaaaacagcagcctttgacccgcgaccaccgcgaactgtatccatctctaaatgtcctttttcggttcgccggttagctgactcactgcgaatctcaattgaggtgcccactgcttggttatagcgcgaccgaaggtcttgtcttcttttatgacgtttaccgtgatcaaagagttggcttggctgaaaatcgacttgtctttgataaatccagtggtaaatcgtgtgtggcgcacagtgaacggcataaccgaccatttcaggggaccaacctaggtttagcttctcagttaccatccgcttcaacttaggcgttaaaatcgagtgccgaccacaacgatgccgacaagtatcggcatgatcctgagctataatggcgcagtaatcaccttcagggcaacggtgaagctcatgcctaatagaaatacgagagcggcctaaggtcgcggcgatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggaagctatttcttatctaacgcgtccttacaagttaggttgactctggagctgtcaaatcattccttccttatcgagaacagaagaaatcaaatgtcattgattaacccggtttttggcgacagcaagcagtagcttcatgacagtaaaccaatatgcttatacacaacggttgacgcgaagtaaaaaagatcctgtcagaaattattcaagttctgacaggatcttagcaggtaaggcttatttacaagatattgtggaccccaaggtttttaaaaactgagccgtcaattcagccaccgaactagaacactcggactaaataactatgccttccccgccgtctgcggttccgtgttaaatggcaccaaattccgttcgattgcctcgcgctgatcttccaagaatggtggtaattcgaggtgaacaccggcttcttcgtaggtttcatctagtaggaagcctggaccatctgtcgcaatttcaaacagaatgtctggaattggtcggaagtattcggaggcgaagtagaagcgatcaacgaagcctgatgagtttaaaccagcagcaccgattttttcgatccaatgctggaggctgtcgcgatcatcggtgcggaaagcaaggtgatgaacgccgccgaagccttgataagcggctggaatcaaccgttgatagtcgataatgacttgcgcaccgtggccgccgtcattgagttcaagcaaggtatattgaccttccttggcgatttgcttgaagccaagcagatcggtcataacaccgacaagttcgtcgtagtggtcggtggtgatgtactctgggccgaggccgccgatcgaaaactgcggatcaacggttgaatggcgccaaggcgtgcccgcgggaacaccatggttatgctcgtcactgatgagttggtactgttgaccgtcaaaatcatggaagcggaggatcttggcgccgaataactcgtcaatcgcatcgtgatgcacccgatacgtgtcgaagcgatcgatccaataggtcagcgcggcatcagacggaacgcggaagctggtacgcgcgatttcattattaccatgctgagctttttgaatccccggaaagtcgaaaaaggtgatgtctgtcccagcagtgcccatatcatcggtgaaatacaggtgataggttcgcacatcgtcctgattgacagtcttcttgataagatgcaggcccaaaataccgctcataaaatgaaaaatccttggtgaacttgaggtgatggcggtcaagtgatgcaatccagtgagttgattagccatggtcagtgctccttttacttacatttagtaagcaaaaggtaccacgtctcttgtgaaaagacaagggttgcgttttcgttaaagtgcttaaggtcttttcaaaattcttggctctgaggctgatgatcctggcaggcgtggtatgctctcgacattgaagatttgtcagaccaaaaggagcgcgtgccagcgatgtttaattttttggataatcctgcagagtacaaacgattgatgaagatggagattttggtagccgtcatggcaattgtggctagtgtggtcatgtttcgattgagtgtcatgactggtgctttgttcgcggccattgccggggctttcttcatcatggatgcgattgttgaaggcttgcgattacttggtgcgtcacatggttttagccgcttgatgggcaccttaattgcgattccggcgttggcggggtatttgctcgtgatgatgaccttgtttccggcgccaatggtctaacgataggcgcgtgccaagactgggtgtcagtcggcagccaagtatgttgagcaaatgagcattaaaacaacgaaaaagatctttgtacggacgcgtgtggcgttctgtacaaagatctttttttgagcgcgagcaggcgtgtttggaagtcggaacataggggacttgaagccaaatgacccaggcttggtcaattagcttcaaggacatcacctgtaggtttctgcaatggcgagcgcgttatggtgcgttgattaaaaatgaaaggcgtcattatcggcaacagcatcagccgtcaattcaaagcgcgccagtggaactttggtgccatccggtaaagtgcggtcgtggtgataatcaccgacctgtgtgaagacgttggcggctaacaatttcgctgctcgttcgttggtggctggcaaaatgacataaacccgtttgagacctaattcaaagaaggcaaagccaagcatccgtttgaggacttcactcataacgccttcaccttgacgctcggccaaggtttcgaagcgtacttgggcaacggttttcttttcactgaagttccaaatacagaaactgccaagaaaatcaccattggcacgatccttgatcccgtataacaaggcgttgttactcatgacgaggcgcatggaacgattgatgtagcgggccgtgtcggtgatttcttgatcgaattcacggcctgattctgcggcaatttgccgatcggcgcgcaactggaaaatatccttgattttaaatgtcgtcaaccagtccatggtgtaatgcacggacatgattggatggtacttctcaaaactttgcatgttatagcctccgtgatggtgatgacgttagcttaccatagattgcgcaacatgcgtgctttgagcctaatggcgaacaatccgttgacgctgcgattattaaaaaacgctgatttcatttttgagatatcagaccatctgtcaagacacgatgcccttagtggttattgatggtcatttgagaagtggccaaaaagtgattgtgtgaggatttacacaaatcattttttattttttcatgattcaaataaaaagaaaaaatgacagaatatagaactcgcttatataatcaataacattgagaagggggagtgatacgaatgaagcagcttttttttggcttttgtctgggttgatgttgttacagccgcttgtctcaagcgcgagcacgcaacttgctaaatcgctcatgccaagcgagtcttcaacctcagcgactgacagtttagtgtctggcgctgaaagtatccttgattcaagtaagacgtctcagcctagtaccagtcagcagaaaacgacacaggcgaccgcatcaagtgccaaagcatctgccagtgtcgaaaaaccgacgcaagccaaagaatcgtcggcaagttcttcaaaagaagctgctgcatctgctagtgtcgcagtatcagcggccaaaccagaaccgccaactgcggccagatcaaaaagatcaattgaagatagtcggttgcgatctggtgcagcgccagtgtttgatcaagatcatccatgcccggtgaaaacaaccgccgagttaaaagaagcgattgagaaagggattccttatgtgcgattaacggctgacatcaatattggccgcgaagcgattcccgtgaaaaactcagtcacgatcgatggtgatcacaagtatacgtacatgtacaacagtggcgaaaactggcatcgcggcatctactttaacgccagtaacattagcatcacctttaagaacttgaaaatcggtgatcgtaatgtcgctgaatcagccaataactactatgggatcgcaccagccgacaatcacactgaaaacagcaagatcatcgttgaaaatgttgattactattctgatcgcggcgctcaaccattccatatccgcaagccaagcaaccagatcgttttcaaaggtaagaatacattttatacgatgaaaaaaggcgcgttagttcaggaatttgctgaagcaacgaattacctttttgaagaagattcagataccacgattgaaatggcagacaatccgctgctcggaacattctgggcatcagccggatcgctgaacttggaattgaaaaagcgcgctcgtctgaaagttgtgagcagtaatgccttggtttacaccgatgggctcgctcatcacaacaatcgcatcacaattggtgaagatgccgttctggatgcttacctgacggacaaaaatgacggtgccctcatgtatcaccatgacgatttagtggtagatgtccaaaagaatgggcagttgttgatccaaacaaccaaagccacgccatttacgaaagcatcaagcatcaatcttggacccggcgccaaggcggacttaaaaaaccttcgcggtgatttcttccactcaggagatggcacgatcaagattgacaatgccgacgagttatcgttcgggtctggtgatcacggtactaaaagtcccactggtttaacggcaggaaagtccgcgaatctgatttttgccccgttcagtgccgagacaaaaggttatgacatttatgccgataatcagttgttagaaacccaatcagatgattccgattggcaactgaatggcaagaaagttgaacgtacgccaaccaagttagacaaatcggcggcgaatcgcattcaaaagagcacagccttgaggtttacccgcaatggctcaccatttaaagcaacggctccagatgtgaagccgccggatcaaccgaagccagatgagaaagacaaacagtcgggcgcattaaaactggtggaagtgcctgactttgattttggcaccttgctcattagcagtgagactcaggttgtgcgaccgcagattcgtgggaaattgttaattgaggacagtcgaaagattgccaaaaaacagtctcggctatcgatgaaagtgattcaaccattcaaaaatggtgagatcgatgtgactggcaacatgagttatatcagtcaaacagggcaggaacaggttctgtctgaccagagcatcttagttgaagaaacagctgatgtcgatcaacgcgatgttagcagtgagtggaatcaaacgattgacagcagtgcccgtgggtttaagttgacgattccagttgagaaacaaaaactgggcactttctcgggaaaagtagaatggtcgctacaagatgtgccggctaattaaggaggacagaatgaaatgaaaaaaatgattttactgactgtcctcttattgggcttcgcctgcaacccgttttcacaggttgatgcagccgaagcaggggatggctatacctcaggcgctgaagttggcttttacgaatcaccgtcatccgctagtactgacagtcaggctaaaaaagcagggacagggcaaactgatggcgcgaaagacaggtctgatgcgcaaacaacgaatgcggatcagttcggcttcatgccacggcttggtacaacgcaagcttggctttgcagcatggctggcttgttgacgatactcattatcacattgcttttgattctcaaacgaaatggaaaagacaaggaagaggaaaattaaaaaatgaaaaaaagttatctagtggcatcactggcagggttaaccctgattggtctcagcagcatgccagtctcaatggttggggcaacgactgaagttgtatcagacggtcaggtgatgtttaaaaccgatgtcacccggacaccagcaaagaatccgcttgatccaggcgacaccaagccaggtaagccgactaatccgaccaacccaactggcacggcaaccaatggtaccaccggaccactatccttggactatgcttccagttttacttttggcgaagcaatgattagcgcagacgatgctaagtactatgcgaagccgcaagttttctcacaggatgacggcaagaccgtggatcgtcctaactttgttcaggtgaccgacaagcgcgggacgtttgaaggttggacattgaaagtgaagcaagaaaaacaattttcagttaaagatgatgacactaaggaattaaccggtgctcagttgaagttcttgaatggaaatgtgacatcaacaattgatcagcagtacgcgccgactggtcaaaaggaaatcacgcttgtgccaggcagtgctgaggtcgcaccgcttgcggctgctaaagatcagggcatgggcacttggatttatcgattcggggatgaacagacgatggccaagtcaattgagttggcggtgcctggaacttcgccgaagatggccaaggaatatgtcaccgaattgacctggacgttagaatcaacgccaaccaacacaacaccgtcaccaaaaagctaaagagccacgtggaacagtgattcgggggggacttagcaccaaagcagcaaaccgacaaagatcattagcttcgcatagcgtcatcactgacaacaaagattgctggcacctgacaaagatgcacgatgaaaactaaaaaatggagtgttatgatgaaaaaatttgttttattagcagccgctgcagccatgggtaccatggccgtcaatgccacgaccgtactcgctgcccaaactaatggtggtgtgtacagcacgaacggttcaattgaatttaagccaacagaaaaagtgacaaaaccagtcgatccgcttgatccaactaaaacggccaccccaattgatgcggaggatccgaagaaggttgttcaaccagggacacaaggcccattgtcgattgattttgcttccagcttcaattttggcaagcaagaaatcacttctgaaaccaagacttactttgcagcagcacaaaaatatcaagatgctgcaggtacggaaaaagtgggacccaactttgttcaggtcaccgataatcgcggcaccgaagccggttggaaattagttgtgaagcaaaatgaccaactcacgtccgttagcgggaaagaattaactggtgcacaaattcggcttaagaatgggcatgtggtcaccgcctccaccgcagcacaccctgatggtacagccgagatgaccttggtcccaggcgcagagcaaacggtgatgaacgctaaaaccgggtcaggtactggcacgcacctattgaactggggcaaagatgccgatgatgcggcacgcagcgttgaattgaccgtcccaggcgccacgacgaaatacgctgaaaagtatgcgacaacattcacctggactttaacggatacaccagataacaagtaagctcatgattctccgaaaatgttggacgcaattggtttccgttagcgcacatacattttctagcatctagttccaacttgaatagacatgaccgatcacatcttaaaagacaaggagatcctttgtgaaaaaagcaattttctgtatagcggcgtttgttgccatgttgatgacccctgcagcccatgtttttgcctcagaattgaactttgcggccaaggcccagatgccagacaatcaggtcaataaaggtgttagctattttgacatcaaaatggatcagggtgctaagcaggccctgcatgttgacttgcgaaacgatacagaaaaagaggtggctgtggatgttggcattgccagtgcaacgacgaatattaacggcgtggttgaatacggtcaaaatgccatcaagccagcgaaaagccttgcctttaacatgaaggattatgtcaaaacgccagctcaggtcaagatccccgctaaaggcagcacggttttaaatcttgatgtgaccatgccaagcaaaccactccatggcgtgatggcaggcggcattaccttgaaggaacatcagccaggtgatcaagctgcaaaagatgcaggtaaaggggttgccatcaacaatcgcttctcctacgtgattggcttattgatgcaacaaagcactgatcaggtagcggctcatgtgaaattgaatgatgttaagccgagtcagatcaattaccgcaatgtgatcttggcatccatggaaaacgatgccgcgacgttcgtcaacaaagtggcggttgatgccaaaattacggctaaaggttcggataaatctgtctatcaagtggctaaagaaggcttgcaaatggcgccggacacgaccttcgattttccaattgcgttagaaggcaagacgcttaagccaggtacgtatgttgctcatcttgaggtgtatggcaatcagcaggcagatggcgggatgactcgtaaaacagctgatggcaaacagcattaccatgatcactggacgctgacaaagcaattcacgattaccgataaagtggccaaaaatctgaatcaaaaagatgtctcgattaaaaaagataatagctggcaattgtatgcactcattgctgttgtcgctgtactgatcatgattgtggcgcttctactcgtcattgttttcaaacgaaagaagaaggagcaagcgtcctgatcaaggatgaataagaataatggtacaatattcgtaagtattcagtgattaaattagtcgataaaactaatggacagggctgcgaatgaatcaatggcaacattgagacgttggcgaattggaacagtcttcttgaaacggtatcttgtgtcgaacctaggtccgcatgggatgcaccaacattgtcgtgacactagattgactaagaaggaatatgagaattcgtgaaggacactgaagcggaagaaaaagcagcccaacaaaatttgcacatttggttatcggacatgtttactgccgatgaccaaagtgtgcgaatttttgatgtggacaggtacaaacaaagtgggaaaacaacgcaacaacaagcatatttggccaatattgcttaccgttttgctgggaaaacattgctggcacgtacaggtacgatctcaaaaacaaggtggattttgtgaaattacttgaactgatggaaaagaacgatcaaaagaaacttcagttactgtattatcttgatcagcatccgaatcgcaaattgaagaacagcgagttgcaagataaattgcagatttcatattatctttttaaacgccagaccaaagagattgctgaagatattgcagcattcgacttgagtgatttttttgcgatcgaagtgacgaacactaccgttatcttgcatgaatatcacaatacgaatgcatcggtttttttggaacattatctaaagcagtcacttcaaattaagatcttgatgacgctgatgcacgaaccaccagcatttaatctgaccgagtttgctgaggaacactttggtagttatgcctttatgtacaaacggtatacggctctgcgggatacgctcaaaagttggggcattgtgctgagtaatgatggcaagctgaccggtgatgaattggcgattagactgcttctgacgaaaatcatggtggttgcgcatattgatgaaaccgggtttgatgacaatgtttgcagtacgctgcatgagctgttgcagttgctgaagatgacagaagcaacgccgtcaatgagtcagctcattgagactaaagcgtattttttgatcagtttggttagattccagcaagggcatgtcattgccacatcaccggaaattgttgatttggtgcgcaatattcgcgagcgcacgctggaaaccagaaaacgggttattgcgatttatcaggcgcattttaccgcaagcgaccagacgattgacagcgagtgcgattattttgggacgttccttgccattattggcattattacgtcggaggagatcgtttttcccgatacaatcaaacagcacggccgggctttcattcaagggtttgaagccaattttgatgtacagttgacattgtctgagaaggccaatatcgaatacgttgtcaacaagtgtttgattgatgtgctggccttgccgtttaggagtgaattctttgatgatcatattgaagtcagttacttctttagaatgtatcccgaattctttgactattgtcagcaatttgtccagacacggtcggttaagttggataggaatcagtcgaagtttatgttttaccattgtttgttgaccttggcagccaatgtgcctttgaacaaggttctggagccactttatgtctgtgttgatttcacgctgggcaaggagtacaacaccattattgaacgcgacatcaagtacttttcaacattgaatgtcaaggtgaccaacgaagtccggccagaaactaaattgattatcacggatttggtcaatgcttatcatgatacggacatttcaaaagtcatctggctgtcaccgccgcgaccagaagattgggagaatgtcattgaagaactgctggatttgcggctagccgatcgcacggtgaaaaaggcatgatgagagcagtgtgatcaacctgttcagtggcatgccgaagccagtgcataaaattcttaagtttatgaaggttataaagttttggtgagatgaccgcaaatggtatactcgccttaacaaatacttggaggcgaggcacgatgaaaagagaaaacgattttgggccggctattaaggactttttctttcgggccggtgactttaagggtgttagttcacgaccacagtattggtggcttttccttgcccaatttttattagggttggctgctggtgttctgttcggcattgcgattccattttctctcatggatagtcattcgttaggcagcaatatcatgttcacgctgacaacgttggcattttcaatctttgggtatcttggctatccacaattgagcttaacgattcgccgttatcgtgacgccaaagttagtccgtggtggtatctgggtattattatcattagttttattggcccgttactagcggttaacggcatgggttggtggttggcattgctgtttcctttaattggcggcattgctaacttggtcattctattgttgccgagtcgagaacagaaagttgttccgtttccggctcaacctaacacgcgcggtacgattggtgttggttttggtacagcggttaaggacttctttatccgcggtggtgactttactggtgaatccagtcgcagccaatattggtggagcattctgtttagcgtgattatcattatccctacttttttgtttatgctcttctcaattatgtcaattattattggtggcgcggcagtcagcggatttaatagccaaaatgttgaccatcttgtgaattcgcttgggactggtgcaatcatcatcgttttcattcttttcgccatcatttacgcgtggtcaatgttagctctgcagcgttgacagttggttggcggcgattcaaagatgcaggcgttagtccatggtggttgattgctttcaacgtcgtatcagcatttctatcaactcttgatcgaaatgcgggtaatgtgccgttaagcttaattgcgttactcctcatcatcgttcagattgtcattcttgctctgccaaccaagtttcgtgacaacgaggcataagcaccactcaaggtattaaaaaatgcagccgcggctgcattttttaatgaagtaaaggtctcctaacgttggctaatagatacccttttcatcctcatctactagcggatcattgaagtttttgtggaagtaggtgctgtcaatgatcttgaatttgccattggtgaagcgagcgatgatctcaccgtattgtacaatcaattgctccgtgttggggatgtcaattttgagacggccaatcggggttttggtgaggtattggtaatttgcgccaaagaagcctttcaagtcgtcagtgctggtttcttgtgagtaaggtaagaagtgggtcatttttgcagttgaaaaagctgcaaattcaccttttggaaatccttgtagtgatgaaggcatttgtgtcatggtgtgattcctcctgattaaagtgctttgctactgtggccaaaacgcgtgattcagcagcgctgtttggttattaatttacttatcatgatggtaacacaataatagaacaattgaatgtttgcgccgcggcctgaaaacgcttaatattaagtctggacgttgatcggaggtgagcatatggatcaaagtctatttcaaaatggtaacttccaacctttggcgagtcgtatgcggccacagacgcttgatgagtttgtcggccaaacgcatttgctagggaaggataaggtgctcagcaatcttatcgaacatgacgagattagttccatgattttctggggtccgcctggtgtcggtaaaacaacattggcgcggatcattgctcggcgaacgaaggcacagtttgtgacattttcagcagtcaccagcgggattaaagaaatcaagcaggtgatgaaagaggctgaacagaatcgcgagctgggtcagaaaactattgtgtttgttgatgaaattcatcgtttcaacaaggcgcagcaggatgcctttctgccatatgtcgaacgcggcagcattatcctgattggtgcgacaaccgagaatccttcgtttgaagtcaatgcggcgctcttgtcacggacgcgggttttcgtgttgcacggcttgaccagtgctgaattggttgacctgttacagcgagcgttaaaagatccgcgcggttatggtctgcagaaggttaagatcggcaaaaagctcttagcccagattgctgattttgctaacggggatgctcgaatcgctttgaacaccttggagatggcggtgacaaacgccgaaaccaaaggcggcgtgataacggtcacccaagcagatgtggcccagttgttgacgaagaaagccttattgtatgacaagaatggtgaggagcactataatctaatatcagcattacacaaatcaatgcgcaattccgatgttgatgcggccatttattggctggctcgaatgctggaagcaggggaagaccccttgtatgtcgctcggcggctagttcgatttgcgagcgaagatatcggaatggccgactcacgcgcattggagattacaattgctgtttatcaggcgtgtcaatttattgggatgcctgagtgcacggttcatctcacacatgcagtcacctatttggcacttgcaccgaaatcgaatgcactctacacagcgtatgaaggtgcaaagaaagatgcgaccgaaacgctggccgaaccagttccacttcagattcgaaatggggtaacggatttgatgcaggatctgggttatggtaaggactatcaatatgctcacaacacaaaagataaactaacgaccatgcaaaccatgccggataatcttatcggcaaaacgtactatcatcccacgactcaaggcagcgaagccaaggtcaaggaacggctagagcagatcaaggcctggcatgcgcaacaccctgaccccgattcgccgaaaaccaagaaaaagtcatgatgctgtgcgattacgtgtgcggcaatccgactacccgtttagaggaggaaaaaaacaatggcaaaaattctcgcagtcaacgcaggcagttcaaccctgaagtggaagctttttgatatgccagctgaggttcagctggcagaaggtttggttgatcggttgggacagccgcaatcaaaagttaaaattaagtatggtgatgggcagaaatatgaaagcgatacgccaattgctaactatcaagaagccgtcgccagtttgatgggtaacatcaaggcgttagggttggttgaacatctgcatgagattactggtgtgggccatcgtgtggtagccggcggggagacttttgccgaatccgttgtagttgatgatgctaccttgttgcagattcaaaacctgcgtgactatgcgcctttgcataatccggttgaagcagattacattgatgttttcaaaaagatgatgccatgggccacggaagtcgcagtgtttgatacggcgttccaccaaaccatgcaacctgagaacttcctttacagtattccctatgactattacaagaaatatggtgctcgcaaatatggcgcccacgggacaagtgtgcgttacgtcagcgcgcgggcagctgagatgcttaacaagccgttagaagacttacggatgattgtgatgcatttaggctcaggctccagtgttaccgcagtccaaggcgggcagtctattgatacttccatgggctttacgccgttagccggggtgacgatggggacacgatccggggatattgacccatcacttgtggcttatctcatgaagaaacttgatgtccctgatgtggggcaaatgattcatatcctgaacaacgattccggcctgctcggtatttccggcatcagcaacgacatgcgggatctagaagctgacgaagataccaagccacgcgccaaactggcattggatattttcgttaaccgcgttgtgaagtacgtgggttcgtacgcagccttgatggacggcgtggatgtgcttgtcttcacagccgggatcggcgaaaacggtgacgagattcgcgacaagatcatgcgttcactcgattacctcggggctaaaatcgacaatgacatcaacaacaagtcgcacggtgttgaagctgatctcagcacaccagattcaactgtcaaaacattgctcgtgccgaccaatgaagaattaatgatcgtccgtgatgtcatggcattgagctaagcgttaatgacttctcaattaaaaaaccatctctcgactgaaggagagatggtttttgtgtctgcataagcttctgaggaatgaacgagcaaacagacaattaattggcgttaatcccctgatctgaatcaatcatgactcctttcgtttcatcgaaaacacagatattgccgtaattttctttataagtcatatgattgccgccatcaataaagtaccggggtgattcgtcaggatattgaatgactttaaccgggcatttaggataaccgtcactgaatgaagttggtggtagagatggtttgacattgttttcatagtcgccataaatcaaggcagttggcgtgtgaccggtgacaattgttttagcgatcggattgtgagcaaaaatgggatgttcccgatttttggtttcatccatattatagatatacggctcacggacccacattcgattaaatggcgtcgtttcttttaaagggtcttccagcgagaggtctagaccggcgtgaatgagcaacagcttgtcaaactcaacagcagttggcatctcggcgatgaattgaatcagcggtgacatgtaggtcaacacggcttgttgtaggttgcttttacgcgctttagctggcgtgtaatcttgcaccatttgacgtaaggtagccttgccgccattgatgaaccatggattatctttgtcggcgagataatccagcagcatctgatcatgattgccacggatcgcgattgcctgactcgcctgcacttgctcgcgaatttgagtgagcacccgcccgccgtatggatagccatcaatgtagtcacccaaatagacggtcaaagtatggggatactttgcttgcatcgcccgcactcgatccattgtttccagatgaccgtgaatatctgagaccacgatcatggtcataacgtttgcctccttataaaacgcatgctccagtcccaaaacctgcagatagggcttttggtcgcaatagtcagcgcttgactgtcacgcttaaaacgacttatatttcggttcctaacaggactgcgccgcgttttgcaaaaactgctgataggaccagtttactttatttttagaagaatgtgcgatattaataggggaataggggtgaaaagatggataaacgcttaatcgtcatgcataatctgagccgtcattatggcaaacaatactggtggcagcagcattcattggaagattggctgatgatgattctcattcagcgcaccagttcaaagaatgttgcccaagccgtgcataatttgcaaccttacatgcaggttgatcgcttgatggcgttatcgcaatcagagctggaaacgttggtgcggccagccggcttttatcggcaaaaagcgcagcggattcacgatctattgacgtggtttgtggcccaaggcggtagttttgagaagattgcagaaaaaccggcagctgagttacgtgaaactctgctggctctaaatggcattggcaatgaaacggcggatgtcatgctaatgtacacctttggcaaaaaaacttttgtagctgatacgtatgccatgcgtcttttcaaccggctcggttttggaccgtatacgaactatgctaaaatgcaggctgattttgcgccagcacttgatcaaatcacgttagacgaagctcgcgaatggcatgccttgattgacgaacatggtaaaacgcaagttcggcatgcgtatgacgaccggtttttgctgcagccagatttgactgaggcggcatggccgccggaagcggttcaagtggagccgccccatgatgatccgggtagcggcaagtggcggcacgccgccgatccgtcagcgatgactcataaataaatgctttttgctcgtgagttgttttggcaatcctgtcacaagggagacctaaaaatgaatgctagcgttgctgtgcaagtgttaccgatgtatccagagaaacaaaaggtcttggcagtggttgatgcggtgatcgcctatatcaaatcaaccggaattaattatgaagttagtgcttttgaaaccacaatggaaggcgattatgatcagctgatggcgattttgaaagaaattccgattgtcacagcgaaggcaggcggtactagtcaaatggtgtatgcgaaaattaactattttcctgaagatactggcctgacgattgctgacaaggtgacaaagttcaagcattgaagacaaaaaaagatcacggcgattgtcgtgatctttttgcgtcttgaagtttatttttcgacagcttggagcttttgattgtcgtcgagttgtgagatacccattaagtgatgacgttgtaagagaatcattgtgccccacagcaacaggagcgagccgatcgtgaaggcgatcaataccatgaagccgaggttgacagtgctattggcaatgccgccggtgagcgcgttccggaaattcataatggagtaggtcattggcaggaatggatgaatggcgttgtagaactgattggtgatctccatcgggaacgtcccgccggcaccacctaattgcagcatcaaccccaccatcgccacaaatcgaccaggattatcgaaggccattgagaggaacataatcagatacattgaggtaaaggagaagaggatcgcggtcagatagaacaagccgatgttgtcgaccttgagaccggtcgccatcatcaaagttgcttcgagaactgcggtgccaagggcaacagctccgccaatggctactttgctcaggaaccactgagttgccgtcccatttgctctggaaaccttgcgaattggataggcaaagttgaagaccaaggcgccaacgtaaagtgccagactcaaaacgtatggggcaagtgcatggccgtagtttggcacataagaataatgcttttgcgctgtcttggtgggtgcagcgaacatctttgccgtatcaccggttaacgtaatgccattgaccttacgtgcggtgctggtaagtgtcttagcgaacttcttgtcgccgtcttcaagctgactggaaccagatttgagtgtgtcgctcttgtcattgatttgaccggttccgtcggcgagttgattgacaccggataccagtgtcggcacactagcgtttaattgattgacaccgccagcaacttggctggcaccattggttagctgaccgacaccgttggtaagtgtcggaacttggccatttaaggtaccaagaccgccggatacttggctggaacccgtgtagagttggttgataccactggtgagagcaggaacttggctgtttaagctaccaaggcctcctgaaacttggctagaaccggtatagagctgattgacgccaccggtaagtgctggtacttggctgttcagagtaccaagaccgccagaaacttgactagaaccggcgtaaagttggttgacgccgctggtgagtacaggaacttgatggttcagggtgccaaggcctcctgaaacttggttagagccagtataaagctgatctacacctctaactagtgaaggtgtttgtgttgccatttgccctatgccgttagtcagattgtttgcgccagttaccagttggtcattgtttgcaataatttgttttgaaccgctttgaaggccaataattgctgccgttaaagtcggaacttgttgattcaaagtcgttaaaccgtttgttagttcttccgaacccggaatcaagctttggctgagagtcgtggccattttggcgccattagtttgagtctgagaaatcaaagcgttgacgcttgcttgaatttgctcaaagcccgcaatcaattctgggttttgattgggttcggattttaacttagcttcatattcagtgagagtgttctgaagcttgggcaaggatgaggcagcttgctgattttgtgaatcaacggatttgcctacttgttgaagaccttgtgttaattgagatgaaccggttaccaatgcttttgttccattatctaaggaactggtactgctagcaagctgatcaatgccgttagagagtgtcgtcacgctttgcgtatagttcttgacaccagttgttagcttttttgaaccagtttgtaattgatttgtaccgtcaacaagttgtcctgcttggttctgcaatgtgtttaagccactggtgaccgcatcagatcccgttgctaattggcctacgccggatttgagtgggtcagtctgcgactgcaaagacgctaaaccactagtaactttattggatcctgttgctaattgccctacaccagacttaagtgtgccagtctgcgactgcaaagttcccagcccattagtcactttagttgatccggttgcaagctgccctacaccagatttaagtgtgccagtctgcgattgcaaggttcccaaaccgctcgtaacttggccagatcccgccgtaagctgattaacgccacttgctaggtttgtcgtactgccattgagcgtttgcaacccacctgcgacttgattagcgccgcttgcgagcttaggtatttgtgaggacatcggtgcaactttaaccttcatcgtttgcacgccgtcatttacttgcgaaacggcgacggtgtactgatcaatgccatcgtcaagtttgacttggccagcatcaatttgggtagcggcgccggctgccgttttcatgccattaccgatagtcttaatttgatcaaaaactgcgctggcataagcgttggtcacgttagcccgaatttcggagttgagactgtcaacgccgatgccggagatgacttggccaatatagttgagtgaatcatttgtctcgtacttcagcgtcattttcttaggatgttcgtctaagacggtggcggcatttttggaaaaatcctttggcagcgtaatgacagtgtagtatttgtctgccttcatgccctttttagcttctgcttcagaaacgaaatgccagccaagttgacgatttttcttaagcttggtcaaagtctgcgcaccaacatcaagctttttgccttgataggtgacaggttggtcaaggttgaccactgctactggcagattcttggtgtcaccgtaaggatcccagactgacttcaaaaagaagatacagtagagaaatgggattaaggtaatgacgagaactgagagcaaaatgagtttgtttttgccgatgaacttaaattcatctttgatcatgtcgagttactcctttacttcactgagatagagatccagcagggattcaaaagtcgtatcgcggctaggttggccatctggcaaaaagcccatgacttccagaacggtaaaaccgagcacgctgctgataaaattttggacgaaactttcttttgccatgtgtttgaactcggtatgggtgatcaagcgttttaataagccgatcacatcgccggttgcctgaacaaatggactgctttctggaaaatgatgcacaaagtaaataatttcatccaatgattgttgctgttcgaaatagcgatgcgtggtttgcgcaaaagtgcgaatggcgtctttgccagcaatgccactgacttgttcaatgagttcttgatgtaagttgtgcatgaattcagtccccagcgcctcaatcacggcatccaagttactaaaatagttgtatagcgactgggaacgaatattcaattccttagccagtgtctggaaggtgagctcacgaataccatcacgggtcaccatcacccgggcagcggcgagcactttttcacgatccaaaatacgatgcttgatagccatgcgacctccttgagttatctatattacgttagacgaatatacgccgatgatttgaagaatgcaacctacagattgtagattgtcaaaaaataggagtaaccagacgtgtggtgttgcatgtgcgtggctgttcagtggccgatcaccgaggttttttgtcatcatgcgcagtctggagactagctggttgatctgcgtgcacgacaaaaccgcacccaaatgttggatgcggctgatcatttaacggcggtttattgaatgacgtggcgattaggatcgcgcaaattgaggataaacacaagcaccatcacgatgaccaccatcacgaaaacaccgtgtaagccagtgagaatggtggcagctacctgaggatcgtggcttttggcggcagcattagcactaatcgcggcattgacagctttaaaagtgttaccgtgcaaattagcgcgaatcacgagcgtcaaagtggcaccatagataccggtcatcacagtttgcccgagcgaacggccaagggttaggatgctggtggcggaaccaacgtattctttgccaacaagatgctggctcaaaacggtattcatactgatcacaatgcccatcaccgtgccgttaatcatggcaatgacataaaaagcccaaaccggaaaatgcggggaagcaatggtgagcaataagtaagctaaggtcagaatggcgacgagccaaagtgtcatggttcgcggcacaaagcgtttgattaatggaccgaccaaaaatgaagaggcgagccaaaggacagaactcgatgtcacaactaaaccagctgttgtcgcgccgagatgatacaacgactgaagccagatcgggaagtaaacttgatagccaatcaagacaccgctaagtaacaaggcagttaaaatttgcactgtgaacgtgaagttatgaaacattttcggcgcgatgagcggatcgggggctttctgttcttgatggtacaatagcaagccagccgcaagtgccagcactaacaaaacgccagcgagcactggttgccgatcaagcgcctgaatgccaagtagaagtgcaatcagcgtcaccgccaaccaaagaatccctaaccaatcgatcgtgagaacgccgtgttcacgactaggttcccgataaccgatttgaataagcaaaaaaacgagaataccaagcggcacattaacgaaaaagacccaatgccaagacaattgatcaaccagaaaaccgccaattagcggtccgaccaaggcggaaagtccccaagctgtgttattaagggctaagacattcgcccgatgagcaaaatcataataatcagcaataatggtaaatgtcagcggcatcacggcgcctgcaccgataccttggagtgcccgcgccaaaatgagcaagaagatatgcggtgccaacccgcttaacagggtaccaagcgtgaacagtaccacgccccactgaaaaataccgcgcctgccaattgtgtcagctaatttaccataaatcggtgtggtaatagcggttgtgagcaagtaggcactcatgatccaactttgatatgccaatccatgcaggtcactaataatcgctggcaaagcagttgtgacaatggtaacttcaacggaagtcatgaatgtggcgataaaaaccgccgccatgacaagcccgcggttttgaggctttactgatgtggacatcttgacatctccttgataaatccattttaccagtcagggtcaaggctgcagcacaaaaaaacgcccggtaactaaccagacgcgtcgacgttctagtgacatagcaggcagctgcggtcaataccgatggcatttccatcaggaaaacaataataccagcagctgtcaattggccaatgattacaagtccaacacttccgatcaaagcgaagagtcgcaatcaccaatcaaactgtgacaatgacaaaacatctccgaatgttcaaactaaaagtcagtccaagaatctttgttggccggtgcatcatcaggtgaaacatacacgacgagttcatcactaaatcgtttgagacagtaagcggcggcgccaatcagcgtcacggccatgaccgtttttaaaagatgtttgcccataagtgacctccttagtttgccttgattaggaaccatgcatcattaccttcattctagcacggtaaagttcagaatgagtccagtttagcagcgagcgttttcagaatagtttctcagtaggtgttgtgcacgctaaaatctggtacaaaccgattttttaaaatatttaaggcattttaagtgaatttaagtcaaagtaagtgcttttttcggaatctgtgttatactgaggtcattaaaatcgaaagtaggtatgagcatggatacaaaagtaaagactgttgattactcatccaaggaatactttgacaagatgaccgcttattggcgggcagccaactatatttcagttggtcaactttatttgaaggacaacccgctgctggaacggccgctgaagagcgaagacgtcaagccgcatccgatcggccattggggcacgattgctgggcagaacttcatttatacccacttgaaccgggtgatcaataagtatgacttgaacatgttttatattgaaggcccgggtcatggcggccaagtgatggtttccaattcctatctagacggttcgtattcggagatttatccgcgtgtgtcgcaggataaagaaggcatgaagaacctatttacgcagttctcatggccaggtggcgttgcttcacatgcgagtgcacaaacgccaggttccatccatgaaggtggcgaattaggttatgctttgagtcacgcaaccggcgcgattcttgataatcctgaggtcatcgcggcggttgtcacgggtgatggtgaaactgaaaccggcccattggctgcatcatggttcagcaatacgttcattaacccaatcacggatggcgcgattttaccgattgtgcatatgaacgggtttaagatttccaacccaactatcttgtcacgtaagtcagatgaagatctagacaaatacttcagtggtatgggttggaagccattcttcgttgaaggcgatgatccagagaagctgaatccggaaatggctaaagttttggatgaagcaattgaagacattaaggccattcagaaacatgcacgtgagactggcgacaccacgataccacactggccagtgattattttccggtcaccaaagggctggacaggcccgaagagttggaatggcgaaccaatcgaaggttccttccgtgcgcaccagattccgattcctgtcgacgctgaagatatggaacacgctgattccttggcaggctggctgaagtcctaccatccagaggaactgttcgatgaaaacggcaagttgatccctgaattggctgcattgccgccaaagggtgagcagcggatggctgctaacccaattacgaacggtgggattgatccgaagccgttggtattgccagattatcgcaagtatgcgctggacaacaaggaacacggcaagcagattaagcaagacatgatcgtgtggtctgattatctgcgtgatttgatcaagctgaatccgcataatttccggatctttggccctgacgaaaccatgagtaaccggttgtatagcttgtttgaagtgaccaaccgtcaatggctggaaccaatcaaggaaccggctgaccaatatttggcaccggctggccggattattgactcgcagttgtccgaacatcaggcggaaggctttaacgaaggctacacgctgaccggccgtcatggcttattcaccagttacgaggctttcctccgggtcgtcgattccatgctcactcagcacttcaagtggattcggaaggcacatgaagaaccatggcataaggcttatccaagtctgaacgtggtctcaacatcgacttccttccagcaggatcacaatggttacacccatcaggacccaggtattttgacacacatggctgaaaagaaggctgaatacattcgcgagtatctaccagctgatgccaacagcttgctggccatttctccgaagttgttcagctcacaaaataccgtgaacgtgctcatcacatccaagcagccgcggccacagttctatagcattgatgaagccactgttttggctaattccggcttgaagcggattgattgggcttccaatgatgatggcgtcgaaccagatgttgtcattgccgctgccggaaccgaaccaaacatggaaagtcttgctgccattaacttgctgcacgacgccttcccagatttgaagattcgcttcattaacgtggttgacctgctgaagctgcgcagtccggaaatcgatccgcgcggtttgagtgatgctgaattcaacagctacttcaccaccgacaaaccgatcctcttcgcttatcatggctttgaagggttgattcgcgacatcttcttcactcgcccgaatcgcaatgtgctgattcacggctatcgtgaagaaggtgacattaccacaccatttgacatgcgggtactcaacgaacttgaccgttaccacttggccaaggatgttattcagcatgtgccagcctacgctgaaaaggctgccgcgtttgttcagaagatggatgataccttgcaatatcatcatgacttcatccgcgcaaacggcgatgatattccagaagttcaggaatggacctggaaaccaattaagtaacttcagttgtctttcaaacacttctgcttgcgcaggggtgtttttttgtgtgccggactagcaagttggcgatggcgcggcgattcacgaaattcacatatttaaaaagtgggacgtgagactttgatgagtaacttctgctgctaaaaaggccacgaaaacaagtaatatctgcaaattttctctttactttcttcatactctaatgtattctcaacgtaatatcattttgagggtgagtaaatgaaagttaaacgattggtagcaggggcaatggtatttgcctcagctgcactcttggccgcatgtggcagcaagagtagcagcagtagctcagaaacttttaatcgaatggaaaaagatgttatttccacaatggataatgcccacattacggatgttattagtgggcaagccgccgttgatactggtgatgggttgtatcggtataaaggcaagaaattggaacctgctgttgccactaaagtcgttaagccaacgaataacggccttacttatacattcaacttgcggaagacgaagtggagtaacggcgatcctgttactgccaaagatttcgtctttgcgtggaagcgagcagcagatccgaaaactaagtcagaatatgcttatcttttctctggcattaagaacgcggatgacatcactgctggtaagaaggctgcttcaacccttggtgttaaagcagaaggcgattataagctggttgtcacgatggatcggccagtaccgtactttagcacgatgatggtcaatccggtcttcttcccattgaaccagaagacggttgataagtatggcaagaagttcggtacgcaaagcaagtacttggtcttcaatggcccgttcaagttgactaactggaacggcactggcaattcatgggatgaagtgaagaacacttcttactggaacgccaagcaagttaagctcgataagattcacgttcaagtggttaaggattccaacactgccgctaatttattcgctacgaagaaacttgacgatgcggttctgaccggtgaaattgctaagcagcatgccaaggacaaggattacgttggcgacaagcaaggtcggaccacttacttggatatgaacgaagaaaaggtacctgacttcaagaatctgaagttgcgtcaagctgttgcgatggctattaatcgtgatgagtttgcgaataaggttattggcgatggttctttcggaatctcaacgattacaccagaaaactctggcagtaatccaaagactggcgaagacttctctaaggaagccgctaaggaatctaagacagttcagacatacgatcttaagaaagctaagcaactttgggctgaaggcctgaaggaagtcggtaaatctggtgaagatgtgaccctgacgaccgatgacacagacgttgctaagaagtctgctgaatatctgcaatctgctttggaacaattgccaggcatgaaggtttccatctcttctgttccattcaagacccggatccaacggtcattagatggcagtgctcagttcattctctccggctggcaaggtgacttcccagatccaatttccttcttggacctttacacgactggcaacacttacaactttagtcactggtccaataaacaatatgatgatctgattaaggcttctaagggaacggatgctaacagcgaaaccaagcgatatgatgatcttctgaaggcacaggaactgctttctaaggaatcacctgttgcaacgctttatcaaactgttcaaggccatttgcgcaatcctaagctgaaaggtgctactttcagcccagccaacatgtataactttgttggggcttatatggctaagtaatattatcaaaatcaaaaaacatctccattttgttcagttcaaggtaagttgactggcgatggggatgttttttttgttctgaataatgctgtgcagacagacaaaacatgtcttgggttggtaccgaggtgggtaggtatcgccagtcactttaaaataacaaaatcatatttatgtatcattgacaatgatagtgagatccgtttataaatccaatgatgaaaaggaaataataatcgaaggttgtgaagaatctctaaaaataaaaaacgataaatgattgacgttttagtgaatgaaatgtacttttaaccatatccaatgcaatggcgttacatcaagggctttatcgctgccgattagaaacatggaaaaagtgtaggcttgtaaggaggctaacattggttttcagtaagcagtattggaagactagatctacgatcgctgccttcttattggcgttgctgtttctcttagggcatctcttgggcaatcttggctacgaagttaatggtggtaagcaagtggcgggatacttctttttctcaccatatatgaactggctaccagtcgatatttcctcaaatttaccgattgcttggaacatggcagcaccgttgttgtcagtacttgctggtggtatgtttgctgctaaccaaggtcggaatgggtatgcacagctgctccgaactcgtcaaagttttttaacttaccggcgacgaacgtttcttgcggctggattttggggtgccatgttgccgattgttgttttggggttggactttcttggtctgcttgtcatacacccgaatgtattaccgagtcagtggcttaacaacaatgtcgcaataagttatttaggcttcggcggcaatcttttctatgcccatacttggctatacatgctaggttgggttttattggtggccctctatggtgcaagttatgccattttctctaactttctctatttcctcacgaagaaaatggttgtggcattactgggattgatgggacttcaactgttacttttgagcgtgagtctaatgtcgcaagtgagcttggcaccgattgcttatctgcaaattgttcccacgattgcccaaccatcaatcgcgtatgtcattttgtggccagtggctttaattagtattagtctattagcacttcgcatacccgtgatagaggcgtgaacaatgccaaaaagaaattgctttctaacagctcaatttgcccctcggtggcagcgagtagcctttcttttggcgacattgctggtgtcactttgttttacctctatagggctgacgaccgggcgattccagtcgggtttctttgatgcgaatcgatcgatgcagcgcctttttggtcaactggtcctttttctacctatgacgggcatgatgacggctgtgctcttacgactgttacaaaacaccagtgttctaataagaattgacgctcgggtcatgatcgctcggcgtattttgagggaattgatttttttgaccgctgtcgtcactttttcagtctgggggatttggttcactgccgtcctgttacggtcaaggggtggacaaagtggcaccgccgtcgtggctaatgtcaatttggtcatgaatgttgcagcagccctctttacttatacgacgctgacactgataggatgtcttttatttaggtcgcgagcaattggcattttctgtggattgagtttggtgattgtttttcatgtggcccctgttttcaatctgagtgaaatcgcgactctgatcacaccaaaattagccgtaaacgctatgtggccaatcagtgttgttaaacagtttttgatgataatttttgtgacgggcttgatggtgttaactttgaggcgtattcgcttaccggtagaggtgtgagtggcatgcaaaaacgatggcaagtacgactgctaagacaaagagtcatcattgtgatactgctatttgtcggacttctcatggggtcagtggcgttgtattttgaagatcgcacaaatgggttgcttcgccaggttcacgactcagtcatgatgatctttatcggtgcatcccccgaacgttttgccagtagtcaattactgtggctgctcctttggtttggctacatgttgttaccgatttttgctagtgctggtatcacgcatacttatcagcagggactatattcttatctgaatttacgatttcgcccgcgcgtcttaacttatctgtggcctttgaagcaaaccttgatgattgagactgggcttttgctgttcatgggtgccgggtttgggctaaccacttttttattctggcgagagcaacagctttttacagccggcttgtttaccggcttgattgtgatgagtcaactgctattactggtcatggaaacggttcttgaaggttattttggcatcgtcatcggtgtcgtcggccccttggtcatgattttcctgagttttcttcaagtgccattgatgccgttgcgctttgcgattggcagtacctttgctggcgatcagcagatattaggcgccatcgggtaccagttggttttgatcattggattagtccttattcagattttttatatgccaggaaggtgggggcgttatgccgcaaatcacacgtgagccagcaattcatttagaggttgaacagttgtctgtcacaattaaacgaaaaaagattctcgatcatctgtcactttcactggtgtcaccaaacatttacggcattgtcggcccaaatggaacgggtaaatcggttttgttaaaaacattgttgggatttattcgaccatctgctggtagtgtcaagatgaatggcgtacgggttgacccgcgtcatgatctaccagtcagcgttggtgcgattattgagcatccaggatttattggtgatctgaacgggcacgacaatttaatggcattaggcaacattcgcagtcaacttagtgacgcggatatacgggcgattatggaaaaggtcggcttaagcgatgataggaaagccgttgccgattattcacttggcatgattcagcgacttggcattgctcaagccatcatggaagatcagcaattaatcttgcttgatgaaccgactaatgcgttggatcgtgaaggggtggctttcttgaccgatttattaagagagcttcgtgatcaaggcaacttggtcgtggtagctagccacgatttcatgtggctgcagcttttagccgatcagatttttgaattgacaggcggccaacttaataagctggaagctgggcaaccactatgaaaaagttgcatcgacgtctcttggctgttgggcttttggcaatgattatgattttcgtagcattgtttagttggcgttatcaaacacttaacgcgccattggcccaccctgcagtgaagacgcgtagcctaagtctgcctacaaaagttgtgttacatcgaaggacggtttcacttgaaaaagtggaagcaactatcgtacacggtcagtggcgtgtccggcttcattttagacaaccgatcactaaacaaaatatgaaacatatgaaatttcaactggcccaacagcgggaggggcgggaagtaccaaacgaaccacaagccgacttgagtcaagatcagaaagtgatcacaatgatggatgcgtactatagtcgggcgaccgacaatcgggttgtgatcacgaccttgccacaagcactaaactcgcagaatctggttcagatcgtgccatttgaatcatcgagaaaataaggcaagagcatgttatgtgagctgtgtttaactgaaaagaggttgatggtgttggtgcaagaaccgaatgatttacgctttcaagtgcatccgcaggctaaattcgatgtccgggcggcggtgttgttggtgcatgcaggccaacttttagcgacagttaactcggcaagcggtatcgcccttgtgccaggcggtgcggttaaatttggtgaaacggcggcagaagcggctgctcgggaaattcatgaagagctaaagctgaacgtggtgccacaactggtggggatcgtggaatcgttttggcaacaacctgaacgaacttaccaacaactcatcatggtacatcgggtgacgttgactgatgcacaaaaggctggcttggtttggcaggaaggtttggagggtgagtggctgccgtttgcaaaggcagctagggtgttgcagccacgatcactggcacagtttttaacctccggcgatgcaattcgccaccttgtcgaccatcatacagaatgacgcctaggttgacgctggtagagaggtaaggctattgatactcggatcaacagaagcgcctaattataaatagtataattaaagcggattactttgcctttcatcgttttcattgatacgcttaaggtaggctaaaggccggaaaggagttacatcatgatggatatgacgactagaccgacactgcagcactttttatctgacacgaaacatggaccgtatgtttcgctttatatgtcttggccagagaacacctcggttgaggccctgaggttgcggttcaaaaacatggtgaagcataccaagagcgtcatgaccgagacttatcctgaaacggacttttcggcatacgcggctgaacttgagccatatgaacaagacccaacattctggcaaacctgcgaaacaaatgggtttggcatgttgacaaatggcgcgcagacttatgtgacgccgatgtatgaagaggttgatgaagtggcaatggttactgacatgccgcagattctgccactgatgctggatgaggcaacggcaaccgactttgatatcttagcgttaaatgccgacagcattcagctgtatcataaccacggacatcaggtgcggccgacatcgttgccagacgatgcaccgcagactttgaagggaacgctaggcaccgaaattcgcggtggcgaaatgaacagcgtgtcccaaggtggcggacgtgtgacccatcacgggcataatgagaagtcagcggaaaaagccagcgatcagcgtcgtttttatcaagcggtggatcagtatgtgctggccaatcactccaatccacataaaatgccgctcgtactcatgggcttagcggaaaacgtggcggtattccgcgaaatttccaagaaccatcatctgttaccgaagctggctgtcgttaagagcccagcaaaccttgattttgttgaattagacgacttgttgacgccagtacgcgacaccttgcgcgatcgccggcgccagaactttgccgagatcatcgaaaatgctcgcggaaatgacagctacacggatcacttggaagaagtcgttcaagcagccgttgccggacgaatcgccattctttttgtccaagccggcgcacggattcatgcgcgtcttgaaggcacccaaattgaacgcgattcgatcaatgcacagcacgctaatcttttaaatgacttagctgacatcgtccttagtcatggcggacaagttgaactgctgacagaagcctacttgccagtcgaagtcggtgcgatggtgcgttacgcataggctctttagtcgaaatgaaaaagcgacccgccagttggtcgctttttttgtccgaacgtttctgatgagggaactttggctaaaattgttgcttataaagattggctgttttgccactcaatgaatcaaggaattctggtgccacgaaagaaggaaccatcattctgatcgaaggtttaaagagaaaacgtttattgtttttcaacgtaaaaatctccttatgctagttcaagggtgtctgttagttgtgcccgtgttttttccgtcagattgtgggtaatcataatgacggttagatctttctcagcgagtagtgcgtcctctatttcttgggcattttcactatcaatgccagcagtgacttcatcgacaattaagatgggcttatgaaaagcaagtgcgcgcgctaaagccagcttttgtcgctgcccaccagataaattgctgccgtgttcgtgaatctttgttgctaggtttgtgaatttatcaatccctaagaagcttacaacgttagaaagtagtgcctgtgattttgcatggccaagcgtaatattttcctcaatactctcattgaaaatatatgatttctgatctaccagttcgattttggcattaagcagtgttgccggcattgattttaattcgtcaccatcaacttggatagtaccagcataatcacgaagtcgtccgctgataaggttgatcaatgtcgattttccggcgccgcttttccccacgacagcatatttaccgcccttttcgaagttataggagatatccttaatgacgggtttaccttcatagccaaaagaaagatgatcaactgtcaaggcatgattaaacgaatcgtcttctgaaacagtcttaatttttgttgcttgtatgtctttatcaagcaatactgcaacggatttcatttgaaagatgctttgaatcatgcctgcaaggttattgaacactgttcctgctaatgaaccactggcagagataacccctacactgaaatagccaccaataaccaataagcatgttaatgtcatgactagcatctgtgctccgacattaacaccgctaataagcaaattaaccaatcctacatttttggtgtaaagaagtttttcttttccttgatgatcagacgcagtcgctagcttatttgtgagtgtattgccaagattgtgactaaaaaatactgagaagccaccgataatgtcatctgctttgcctaaaaatgagctgttcgcagttgctaagcgattcgtttcatgcgtcatgacttttgagaaaaactggggaattgtcatcgtcaggaggcctaatataatagcggcaagcgctaaactgtaatgatagaaagccagagatgtgattgcaaatagcaaggtagtggcactgcttagaagtgagaagaaggcctccagcccattctgatcaatcatgttaacgtcattcgttagccaagaaacgtattcattatgattgacttttttgtattcggaaattggaacagtattcaaaccattggcaatatcaacgcgcaactgattggttaccttacgaataatctgggcttttaaaagtgagttaccataattaaccgtcaatgtgacgccccaaatgccaatggtagacaataaccaaaaaaccacgccgtgaaggttttttgaaatgagttgatcagttaacggggcaagtgttaaagaactcgcaaccctgccgagtgattcaataactgttaggaatatcatcaggatggttagtgttttttggtttgttaacaacttacttgtagatttcatgagacagctccttttcttgtggggtgtgactttgttgtttttgctgactcaagtatatgtgctaatatggtgccattaaatgttgtttcatatatgaaaaaggggaactgcagcatggaaaaaattggggaactcattaatcattttcgcgaaaacaaaggtatgagtcaggcggaactcagcgaaggaattctttcgaaagcacagctgtcgaagtttgaacgagatttgacgaaaatttccgttgataagtttctggctttacttgaacggctccatgtgacgtttactgagtttgggaacgctttggcaattcaagaaagactgtatgaacaagccatattagaggacattacaaaagcagttatcaataacaacaaagaccaggcgcaactcgtgaaagaacgggcggagcaacatctaaaaaaacaccatggaaagtataatcagctcacgttgatcatggtcaaggcgatgatttgcgatatggaaaagggaacccttccaaaggctgatactaaagtcctcgccgactatttatttagtgttgatggctggacacactttgagttgttgctctttggaaatactatgtcagctttgtcgttggttactgtcaaccaattggcgcgggagctagccgctcaaatcaatgaagcatgggcgatacatcaaaactttcaattgactataaatttgctgtataacgtcgtgattttaaatttgtccgcaaaagacctgacaactgccagactttttttacgggttatgaaacatagccatgttgaagatagtatgatggctgaacgatacctgattgcactcgcagacgcattttgtgactactgcggagagccaacagttgaacatgaaaataacgtcaaaagaatgattgaaattcaaaaagaaatcggatcgacaaatttttttgtcgctttcaacaatcaagcgaagatgttcataaatgaaacgaaaatatcaagtaacgattctgctggtaatgtttgagccctgagatattgcaattcatcgaattgggaaaatagagggtccagtgagtgtttttaccaagatagagagcttttccgcaatagaagtggagaagtggaacatcatttacaaccggcaaataaagagtttgggacataattcttagtcggcaaaataaaagcgaacaattttccacttaaaggaaatttgttcgcttttgtctgctcatggattatttattgcgattttaaagaccgtagtgccaaggcggagcaatcgtaggccagatggggctcagccgtgcaaacaacacagcgaccggtcttggcgctgatgttgttaggcgacttcgagaccgcgggctttgcgggctcgaagcgccgtctccgctctagctacgcgtcgccagccccagctggccggagatcgcggagtttggcacggcaagagattaatcttagatgctttaatgcaacatacaacttcacacttcccaaattgtctgcacaatctgttctgccgttttcaaactagtatcattgaccagtggccgggggctggcagtggtgagccaatgtacgccttcagtagggacgccccagaagaagagaccaggttgagggtgttcgttggcgtcaagcagttgttgggtttggcgatcaacggcgatggcgccggattggaatcgcttgtcagcgttcaactgcagctcatatgtgtgcgcatagccgtcatgcaagagttgctgaattaatgcgttttgcgcagttggcgcattgacagccggcacacgcgcttcgagtaagctcttggcctgaaccgaaaagctgggatcacttggcgttttcaataaaaattgaccattgatgcctttaatttgcatccccggtggcaaaatggtgacgatcccagcgcccagcaaagcttgcaattgatcaattcgcaaggcaggcggcccaatggagagaaagtcattcagcgagttgaaccagcgcaagaagaaatcgaggtactgatcttgactcaacaaaccgcgttcgacgagctggcgaatcgggtcgcgcatatcacgcaaaacttctagtgcgctagttaatggtccagttttggtgccacgcatggcttcgcgtgcatctcgacgcagataatgccgcataaagtcctgataaggctgaccgcttggatgccacttggttggatcagccaaggcatcccaatcaagtcgatctttggcggcaattggcaatgtgcctagcgtcgtaacaggattggcgacgaagtcatgttcaaaggcagtcacgtctagatcggggtagcgttgcactagcaggagccgataataaactagttcaacttcgtgttgcaatgcttcccagaaggtttgaccgctcacttcgccatgtgcttgccaagtattgatctgttcagtcgtcaaaaactgtggctcccattcttcaccgggtcctttttggttgcgaccttttgcccggtaaggaaaaccacgtcgagaaccagtaaaaatgtgcggttctcgaccactaggatgataggccagcaagccgtctgctgttttctggaagcggccgccgcggccttcagttaacctgctcattaaatcaaagaagcttaagccaagtccgcgaatgatcacaggtgcctgcggttcgatggtgctaaggtcaccttcttcagggaaacctggggcaagataaaacaaatcgtgagcgtgggcgtaatcgtccaatgctttttgatcgcgcgtcaaggaattcttgaggttgcctagcgccatgacaacttggtctgtgtgccagctttcttgatcggtggtaattgtgaaattagcggcgtttttagctaaactgacaacggtttgctgcttaaacgtgatgctattgttaccagcgcgggctacaagcatgtcaaagaaccaatgctggtagacaccataaagtgcccgtgaagcgtagttgttgggtcccagtgctgctgcctgccgcagtaggatcgcgcggttattgaactcagggtgagcatcaaggtaaccagatgcagttgtgagtgcccatgtgctcagatcaggtccggtcaagaatggaccaacattggtgaccgtttgatcagtgaataaggtgatctgtgacgctgctgtattcatgataaggttcggatcttgatcgattttccaaacgcgtccgccaattggataaggatcggtcagaacgatggtgagttggcgttttggaaagcgattttgctgccagctgagtagccgttctaaaattaataagccgcgagggccggcgccgatgagggtgatgtgcatgtgcagcgctcctttatgagttgaatatttgtgaagcaacgatttcattatacttgtaagcgccagaaagcggttagcgacatgctttaggtttagccattttcgtgtcataatgtcattattgacaatcttgaaaggaaggcagatgctgatgaaagttgtcgttgtgggctgtacgcatgcaggaactgcggcagtgcgcgaactgttgatgaagcacccagagacagaagtggatgtctttgaacggcgggaagacatctcctttctttcttgcggcatcgcgttataccttgaaggtaccgttggccgattggaagatatgttttatgctacgccagcttctttagaggcgctggggccgcatgttcacgttcatctcaaacatgatgttttaagcattgatgccgctgatcatcggattttggccgaaaatcttaaaacgggcaaccaacaacattatcaatatgataaattagtcatggcgacaggcagttatcctgttgttccgccgatttcaggtgtcagtattccgcgggtgctgatgtgtaaaaactacgatgatgctcggcgaatcaaagaaagtgccaaggatgctgagcatattgcgattgttggtggcgggtatattggtgtcgaactggcggaagcctatagccgcaaccataaacaggtaacgttaattaatggtgtttcgcctttacttagtcattatgttgacttaccacttagtcatgaaatcagtgaggccctgacaacacgtggggttgagttgaaacccaacacagttgccaagcattttgatagtgacgagcagcatgtttttattcaaacagataaaggcgaaatacaggcagatttggcggtggtttgtgtcgggttccggccgatgaccgagttgctgatcggccaagttgatatgaatcctgatgggtccattcacgtgaatgattatatgcagaccagcaattcggatattttcgccgctggtgatgcggtcgccgtccatttcaatcccactggtaaggacgcttatgcgcctttggccaccaatgctgtgcgccaagggatgatggttggcgctaacttgtttaaaccaacgattaaatatatggggacgcaagccaccagcgcgctgaagttgtacgatcataacttaggtgtgacgggtttgacgcttgctcacgccaagcgcaaccacctgtcggctgccagtgtcacgatgacggatgattttcgaccgccattcatgccggacaccgtcaaaattacgatggtgctcgtctatgatactgatgatcgccggattctgggtgcccagttttatagtcaatatgatattgtaaatgcagctaatctcatttctgtgatgatccaaaatcgtaacacgattgatcagctggcttatgtcgacatgctgttcaatccgaattatgataaaccgtggcattatttgaatctgttagggcaattggctgtgacgcaagcagataatacgacggcgtagggggaaaattatgaattcgtggaatcttatcggactgttggcatgggtgatactcatcgcctatttgattttcatcgtctggcacattcggcaacggcacattaaagcaattgttaaatccggaaagcaagttcgtggctcggtggtgttaattgacattgcagaagtgcttgtttttgcgattgccgcgattggcatggtttgggtgagctggttacggcctattgattatcgtgatagtcgtgcggtagctattagccacagcgcagaacatctcattttacaaactggcgaggatcattccttttatgttcgtgtccaaacagggaatggtaagaatccaaccttgtactacacttactggactaacggcgctaaatacgaaaatacaagtcacaatgctgaagttagtgccggtacacaaccgttgaccccgcgggcggcaggctatccatggtcgaaaaaagacctgaaaaaattggatcagacggccgatcaagcctacgtggcaacggtcactgctcgttacaagccaggctttttaaacggtttaggtatgcatgttggcaacattgctgaccgtttctcgattttacgggtaccaaatgatacgtttgtggaaattgatcccgtcaaggattaaattcagtcaaagttagccaaacgaccttctcgaaagtgagaaggtcgtttttgctgcatggttatttttgccagatggcgtgtaagctggtcgaaggctcatggtatcatgagagcaacaattgcaaattttgacagcgcgactcgattcgatgaatgcgtcaaaacgcgtcaaaggaggttcacatgcacaaatatctttggtggctcatcccgcttgtcttgctacttggtattggggcagcaacgcaacagtcggttcaagcggcttcgggaacatggtatcgcgatgacggtgacatgatgggagctaagagccaggcggcggtcaatcgtttgaataatgagacgtttgccaaggtaaagggtcatcctcaacttgcagttatcacggtcaagtcgcttgatgatgacgaaatcgaagactatgccaatgatcagtttgctaaattgggtattggcaaaaaaggctgggacaatggcttgcttcttgtgctttcccgcgaagaccgtaagtattggctagaggtcggctatgggttagaagacgtcgtgccagacgggagcgcagacgagattgttacttcgaacgtgaaaacacagctgaaggcgcagaactacgatgaggcaatcgcactgtttcttgatcatattggtcaacgcgtgacagcaaaccaaagtgccatcgcgacgcctgcccaaataaccgctaaacgggcacgtgatgctgctattcagcaggcaatcttgattgctgctttgattttgatggtcttgctggtactcttcttcgtagtccacatggcgatggctgcccgattgcgtgatgctatgcgtgataccgttgcgttggaggcgatgccgttgtatgcggctgtgatggcagcaggcattccggtacgccgacagacagcttccttaccactattcaaattcgcttggtcacatgccaagctacgcgaaatcggtctggccaatttggctcgtcgtggtttcgagtcgtggacgcgcgtgctgcggttgaccgcaccatatccttattggtactactaccaaacaagcaaaccactgcggcaattagccgatcaagatgtggtggcggccccatctgtttcagcattagcagcgttattaacccccgcattagctgatcgttttgcaaaaggcagaccttatgaagccagttatgcccagtggttaggccaacaaaagaatgttgctggtcaagctgcggtgacaacttggtcgaaatttcttgaaaatgttaaagaaacagatcgtttttcagctgaaatgttggctgccacgtttagcgttatcttgttccatattcggcatccagaaaaaaatcaggatttaagtcaatacgacttgccactttgggttgtatccgactttgggtcgagtgccagcagcggtagcagcggcggttctgacaatttcggtagtggatttggcggtggcagcagtggcggtggtggatttggcggcagttggtaagcaacgggaatgatattgagggcttgaaaccttgttaccacgtgggctaaccttagaaaataaaacaaattgatggcgatgttttcgttgccatcctaaaatgctggaaaacgaggctagataaatggaacaaatgataatgttaatggtcaccggtttacttggcggtattctcggtgccgtgcttggcatcggcggtgggatgattattacaccgattttgacgatgttgatggggttgccaattcaatatgccatcggtgctagtattgtatcggttatcgctaccagctcaggcgccaccattgcttacttaaaagatgagatgctaaacttgcgcgttgcgatgtttctagaaattgcgaccaccgttggcgcagttattggtgccgttgtcactggtcttgtggacggcaaagtcttatacgtcttgttcggcgccttgctgattttttctgcattcaacatgattcgtaaaatgcggatgaaggagcctgaagagcgccagtcaaaaccagatgagattgcgactaaactgcgattgaatggcgcgtattttgacaaggcgactggtaaagaaatcaattatactgtgacaaatgtgccaggcggatttgctatgatgttcggggctggcattgcctctgggttgttaggcattggcagcggtgcttttaaagtgattgccatggatacgatcatgcatatgccgctaaagccatcaagtgccacgagtaatctgatgatgggggttacggcagcagcaagtgcgacagtgtactattttggcggacaattgcagccgcaaatcgcggcaccgctcgctatcggtattttgattggggcaaccgttggctcacgcatcatgccgatgctgccaacaaaagtcttacgtctgatttttattcctgttattggctacatgggtattcagatggcgcttaaaggattcggggtgaacatctgatggacaaaaaactcaaaactgaaattgatgacgttgaaatcatgatcggtaaggtcatgcaaattggggtcgttttgtcggccttggtgattattcttggcctgcttttattgttagtcactggctcaacgggatacgcgaccggcgttcatccaacacgtgttggtgatattttatctggcacgctggcactgaagccgtatgcggttttgatgacgggcatcttcttgctgatcctgacaccggtgttgcgagtggtcgtttcgatttacgcttttgcagttgaacacgatcggttatatgtatggattacgacgattgttttgattatcttgctgggtgcgatgacgattggctacttgggtaatcggtagctcatgagttagctattctgagccggcaaacgaaaagcgccgatgcaaactttaatgagtttgcatcggcgcttttcagtggcatcattatttgccgcttggcttatgttccatgtaatccttcagtgtggcgacgacggaagaatccggcatctcacgcatggatttaatattgtggatatgttcaactgatacgtggctgtttagcgccatctctgtgtctgttagatgatttttgcgctggaagtcaataatctcccgtgaaaatgcactgatttgatctttttcagccaaaacgattcctcctcgtgagcctttactaacagtataacgatttttaccagtctgcgcacgtatgacattcaatcgtaacgttgtcagactgagttgcttgattaaagcggtaaaacaaacttctaatggccaattgcaaagcgacagtaaacaaagctattgcatttacgaacgtatgtttgtataatgaagttgtaccaaaggttaacaccatgttgttcttgatccgctattaaccagatcaaccattagtaccaccgccgatccggactggcctgccaccatcgcacgggatgcttaagcagtgggtaatgatgctggtgcttgtccatgacgaaggtctgatctgcttttgtgataatctgtgcctgtcctgatatgagttgatggaaaagctgccgtttgcgaatgcggtggacaatatgcatgacaatgcctgcgatgacacaccaataactgataacaatcagtagcatccaaccggtttcggcgaagttcaaagatgtcagtaactgccaggtttgcaagatgggatcaagtaataatagcttgccaatataacttagcaaagcgagcaacatacttggttttgataccagcagcagtgcagttaacccgatgaagtaaatggcccaaaacacatatggggcaattgctagcaagtagataaaatgaatgatggcagatggtcgcccaaagcgcagtgagcgccggaatttaggccatgaatattgtttagtttcggaattcgtcatattgccccctagcgccattagcgcattggttgtatcaagttttttggatcattgcctctagtttagcatagacacctaggcgatgatgcttcgtcgtttgcttgacgcaaagacactgttagcttgctgtcttttgttgaaaggtaaggtgagcttatggaacactatgcttatctacaggacttggcagctgatcaaaatgatcggcaattgcgagttcgaatttgggacaataagaatatcatcattcggcgtaatttgggtcagcagcaaggcttagccacacaagtctgggatgcttggctgcgtcaagagttacgacgatttaatggttttgaaccgattatcgaaattgatgatttttcgggtcatcaggaaattcggttttttaaggaaaatgagttggcagatgccgttcatttcatcttgcaaggtgaaggtactgttgaaactgccagttgaacgtttttgtagtggcaacgtcgtgagcattcatggaacttgcccgctgtgaaagctgaattttttaagcgtgtgcatgaaaaaacaacttttcgtgtccatgctttttttgaaagcttttacaaccctgatgttatcagtatactgaaggtaatgaggtgaggacgatgaaggcaatcattttatatgcatcgattacaggcaatgccaaaggaatggcacggatcgagcagcagttctttgaacattatggttgggacgtgacccttggtgaaatgattcaaaccgacccaacgacgatcaaggattacgatgtattggttttggccacttatacatggactggtggcgttattccggaagaaaccgaagacttttacgaggatctcagcaaacttgatttttccgctaagccgttggtatttggcgtgcttggcacaggcgatccgtattatggtaaagattacaataccgcgccagagttgtttgaagccgtgttggcggcaagtggggcggttcaaggagctgaccctgtgaaaattgccttaaatgtcaagcaagaggagatgccccagtttgcagcatttaccaaaagcttgatagccaaggctgaggcgcttcaagctgataagtgagacgatgttgacgtggtataatgaagccagaaagcgaggggatcttcatgagcgaagaaattgttttcttcaaccccggcgatgcagtcgccaatgattttgatttcgccgcggctcgacgcagtgcccaaatttacaaagccgaacatgttgtcgatgaaggcttggttgtcgctaaagataaagacggcaagtattccgttttttacgaagctgccggaacgcctgattcaaaggctaaaggtgactataaagcagttggcaaatatacgattctggctcatctatgacgaaaacggcgtggtaccgtattgtcttggtgctcattgccgtgggcttaattggcgttcttgatcttgtcatgactcaaaatcagatcgccaatccttttttggttggcggtcttggtttaacacttggcattgtgttagctttgttagtcgcaagcatttggcaaccgcggaactcgcgtaagccttgattaaatgaaatggtatttcatccaaaaagacgcctgttaccacatgcattgtgtgacgacaggcgccttttttatggttagtcaactccagcactgattaggcattgacgatgtactcaggctgcttaccagctagaatggctagtgtattgtcagtcacgattttggccatggcatcccgcgcttcgacggtggcgtttccgatgtgtggcgtcaggaccacattatcaagcgccttgagacctgaactgacatgcggttcagcctcatagacatctaacgcggcgcctgctaacttgtgagcctgcaattgctgaagcaaggcggtttcatcaattaacgggccgcgagctgcattgatcaggtaggcagtcggcttcatagtggccattgcctgcgcgtccagcaaatgatgcgtagctggtactagcggcaaatgtaaggtcacgatgtcgctttcacgtaacaaggtggcctgatcggtgaaggttgcgcctagtgtttgctctgtggccgatgtcagttggtggcgctgggtatacagaatttttgcgtcaaaagcatgcacgcgtttggcaacggcctgaccgatttggcccatcccgataatcccaacggttttgccagccagttcgtgaccaaggaaaaaggtgggtgcccagccggcaaaaccagcgccgcgcattagccgatcgccttccgtgacccggtgtaagaccgccagaattaaggccaccgtgacttcggcagtcgaagtggtcgatacttttggcgtattggttacaagcacaccctgggccttggctgcagtgacatcaatgttgttgaaaccggcaccataattagcgatcagtttcagatgtggggcctttgccaaggttgccgccgttactggtgtggacaaggcggtgatcaacacctcagtatgagccaagtgtgtttgtaagtcgctttcggtgattaaaccactgccggtatatgcttcaaaatccacgccagctttttgcaaggcagcattcgccgatttcggcaatgctgcagaaatataaacttttgccatggatcattttcccccttaaccttgttgatcagtcttaacgtctgcacaatcactatgggtgtgcggttagcatcatcatggcggattgcgttacaagttcccgaactgatacttttaagagcctaacttaagtgtagtacaggttagacaaaaagaaagaaatcacatcggaagttttgtcttcttagaaatccaatcatggttaaaccgttgcctaaaaccatatttctagatatacacgctcccgttcaccagcccagaaacatacgtgtaaggatcttgatcgcaatggccaaaaaccggccatcacgctcttgactgaaacgcgttcgcaggcgcagaaaccggagtgtaaggacctcggacgcaatgacccaaacccggccatcacgcccgaggccgcttacactcaggtttctaagcgcgcctgcgaacgctctgatataaaaatatgacgaatcgtggctgattgtgttacactctttctgttaacaaaaagtaagtaaaaggagattgatcatttatggcaactttgacacaagatatgaaagacatgatcggcgcacaattgaactatttggctactgccgatgaaaatggtaatccacaagtgggtcccaaaggcacgatgcgtgtcttcgatgatcatcacctgatttacaacgaagagacaggtaagcaggcatggcataatttgcagtattctaagaaggctgcggttgcgacggttgattacaaggcactcaagggttttcgttttgaagggaccgttgaattccatcatgatgacaagatctttgaagatgctcaggcattcgcgaaggcacatcatctgccagcagccatcagtgccgttttgattaatgttgatcgtatctataaactggatgccggtcctaatgctggcgatttgattgaaggttgatgggctgattcccggactttaacgcggaaaacgagcagctcatgatgccatgatttttaattaaacaatttatatgcctataactttgcaaatatgcatggttataggcattttttgtatacctagtaaaatactaattgttatcattagcatatttattgcttcgaataacctcgtttcgttaagcttaggatagtcagaagaaagtcaaccaaaagaaagggtgagaaccatgatgcattttatttggacactgatcatcggtgcggtgattggttgtattggacagctgatcgttgggcgcgatatgccactcggctggcttggtaacattatcggcggcttagtcggtgcatggctcggcacggcactccttggtgactgggggccttcattagccggaatggccttgatcccagccattataggggccatcatcgtcgtcttccttgtttccctgttgctgggaaccacacggcgcaaggcataggaggccgatgatcatgagacccatcacaaaaatcatgcttggcatcattgccgttggcggtttattgcaaagtgttggtttcgggttattgctttggccaagccgtgagtttacgcgattttatctgcaacaagtcgtttggctgcggccaaccatgataggcctgactgggcttgtcgctttggttttcctcatcatgctattggtcgccattttcaggcggtcaaccgctcagtcgctgattctagctggtgaagatggtgatctgacgcttgataaaagtgcgatcgaaaacaccgtggccaaagcggttgttgcgcaacattttgccaaatcggtggcggtagctgttagcattcgcaagaagcaagtcgcacgaatgcggattgaagctttttccggtaatagcaaggatctgaaggcagaggccaagcaaatcgaagaaactgctcgccagaagctgcaggcctgtctcggtattcctgtgaagcatgtgcgggtgcatctcttgccagccacaaaggtcaaagcgaaaacggcccgtgtgatttaacgatgacaacactgggacaacaagcaaatggcattcaaagcggacactttccaaagatgttgatgcctttgacgacgtgcccagctagaaggagagatgacaatgcagcgaggaatgatcggtgctgtgatcgggatcgtgcttgccttcgcctggatgcgattcgggtttatgggtatgctgctggtcttgatcttcggcgcagcaggctggctgattgagcgttacctagtacccaattggcatgcatttaccagttggttgaccgccggcaaagatgctttcagtaaaggaaagtaggtgaacggatggacgcagttgcaacaccgccagtagcagcatcaccagctgttacacgagaaacattgatggccaatagtcgattgacgtttgaagacaaagtgattgaaaaaatcgctgcgctttgtgctcgagagattgatggcttgctaggaatggacggaacgatgatggacaatctgaccgaaaccttttctagcggcgagaatatcaccaaaggcatctcagctgaagttggcgagaaacaagtagcaattgatatggatgtgtttctggcatttgacagtgatgcgcaagctatttttaaacaactctgcgaaaaaatcagtgctcagattacccggatgacgggcctacagctagttgaactcaatctacatgtcaaagatgtactgactaaacgcgagtggcaaaaaaaatgatgttgaaccttcataagacaaaggagagataaacatggacaacacgaaaaacgctggcatcaataaggaattgaaattcgatgacgctgtcattgcaaaaattgtgggcatcacttgcaatgaagtcgaaggcgtatactcgcttgaaggcggcatgatggcaaatatgaccgatcttttccgcaaagatgaagatccgactaaaggtgtggatgtagacctgagcgatgatcagaatgtttctgtgtcacttgatgccaccgttcgatatggtgaaaatgcaccggaaattttcaacaaagttacgatggcaatcgtcaagaatgtccgccaaatgaccggacttaatgtcactgaggtgaagatgaccgttaaggatatgctcaccaaagacgaaattgctcgtaacgaggctaagaacaaagatgctgacaaagaaaaggatcttcagccagcataatcgtgatataaattgccagttcagtcgttgaactggctttttttgtgagcgtgaggcagcccggttagaaaccggagtgtaagtgaccttgggtgtgatggtcgggttttgaccattgcgaccaaggttcttacacgcaggtttctggggtggcgagcgcgttaaaatgagcgtgaggcagctcggttaggaaactagtgacgcacaagttatttttatagtttgcaggattgataatcccccttaacgaattgacgctgtcaacaacaacacgtaaactgctttcatagaacaaagggggatcctacatggaatacttaaaattacttggcattgtcattatcgttgtcgggtttgcattgaagtgggacacgacagcggtagtggttttggcagcagttgtgacagcagttttttcgggcatgagcatcccggctttgctgaccacacttgggcagagctttgtcgataatcgcatggtgtcgttattttttctgaccctgccgatgattgggttagtggaaagccacggtctcaaggaagttgccgtcaatggcattcagaagctaaagaaattgacacccagtcgtattttgaatatttatcttgtgattcgcgagttaggtggtgtctttggtatctcgttatctggtcaagtgcagttcgtacgaccgttgatcacgccgatggtaacggcggcggctgaaaccaaacgtaagctaacagataaagatatcgaccttattaaggcgcgttctgctgcgactgacaactttggcaatttctttgcgcagaacctgtttgttgcaacagcgggtgtcttgttgatcgcgagcacgatgaagagcctcaatcatccagttgagccgatgcaggtcgttttagcatccattccagtggcattgatcacgttggtcattgtggctatctacaatcgctggtttgatcgccaatttgaacagcagtcgcataagggaggcaaatgatcatggtcaatacccttttattgatcctttatgctctgattggcgtcgtgatggcgattgctggtattgaggcgtttcgcgcaaaagataatccggcacgtatcggaaccggtttgttttgggagatcatggcagtgatttttgcctttgggaccttgatgcccgcgatggtcgttggtgttctagttgttattatcggtattttggcgttgttcaagcagattcagataggcaaaattaagcccgttgacggcgcacacgcggcaacagcggccaaacggcttggcggttgggtattcgtcccaagcgtggtacttgcagtcgtttccatcggtgtcgcccagtttactaaactcggtggtcaggtcggcattggcattggtgcggcggtttcgttaattgtggctatcatcatgacgaaggcgccaggcaaaatggtttataatgatacccagcggatggttcggtcagttggtgctgctggcattttgccgcaattactagcaaccttaggggcagtttttactgctgctggggtcggatcactcacggcgaaattgattgccggcttattcccaactggaagtcatcttggcggcgtgattctatactgtgtggcgatggcgctctttacgattattatggggaatgcctttgctgcgtttgccgtgattacagcagccgttggcattccttttgtcattgcgcaaggcgctaatccggcgattgtggcggctattggcatgacctctggctactgtgggaccttgctcacgccaatggcggcgaacttcaatagtttgccagtcgcgttgctcgaaatgaaggatccacttggtgttatcaaacagcaggcgccaattgcgatactattgttgatcattcaaatcggcctcatgtacttcttggcattttagaaaggaaatcttctcatgaaaattcttgttaccggatttgatccctttggcgacgataaaattaatcctgcgattgaagccgtgaaacgtttgccggatgaaattgccggggcacaaatcgttaaattggaaattccgacaaagtttaatgtttcagccgatgtcgttaaagatgctattgccaaagaaaagcctgactatgtgttgagcataggtcaggctggtggccggtttgaactcacgccggagcgagttgcgattaacttggatgacggtcggattcaagataatgccgggtatcagccacttaatcacacgattcatggcgatggcgagaatgcctactttacccagttaccgattaaggccatggccaaagccattcgggaagctggtgttccggcagcagtctccaacacagcaggcacttacgtctgcaaccacattttttatcaggtacagtatatgcgggataagatgtttcccgatattaaggccggcttcatgcatattccatttttgccggaacaggttgtcactcgtccggaaacaccagcgttgtcattggatgatgatgttttaggcatcactgccgctatcaaggccatcgtcgcccgtgacggcaaaggcgatatcgaaacgattgaaggcaagaatcactagatagttgtggatcattttttatttgaactgccgcagaccgcatgacgggtgtgcggctttttgagtgggctagaatgcttgctggccggtatttaaagaagcaaggcggtataatgaaggtgtgatctcaatagagagggtgattagatgactatcggtattattggatcaggtaatgtcggccgggcattaggccaactgtttagtcatgttggtgaacaggtgattatttcacatcggcatggcgtggcatcattggcaccggttattgcagagatgcgctcgacggtcgaagctgggaccgttgctgacgcggctaaacaagacattgtcgtgctggccgtgccatttaatgcgttgccggaattgccgacaagcgtggatccgaagacgattattattgatgcgactaactattatcctagccgcgatggcgaccagccagcactggcagcacatcaagtcacgtcatcagaactcgttgctaaacattttggcacgaaaaaagtggtcaaggcattcaatacaattgcgatgaccaaaattcgtagtcttgccaagccaagtcagccagcaggaagaattgccattccgattgccggggatgataatgccgctaagcagacggtcacgacattgatcaaacgaattgggtttgatgttgtcgatctcggcagtctatcagatagctatccagcacaggcggatggaccgttgttcttatttgctggcgatgctgatcaggttcgtgctcaagtgcaacactaaagggttaactgggcgccaaagccatatgaaattcgtataaaaagagcattgcccgtatactgcggcaatgctcttttaattatgcaggctgacccatccgtgccttgtgatttttcacaatcatattggcgatcgccttagcaatattttgatttttcaaaatgggaccatgggagtagctgccaatggtatttttataacgcataccttcgacaccgtcttcagggttattcccgtaaccttcaatcattttgcccaacggtttgagcttttgcttgtcgtcaaaataagtccggccactgtgattctcaaatgcggtaactgtcccgaactcggtttcgtacttggtatcaccgatcatgcgactgtctggcttgaaaactgtgtgcagcggcaaaatgccaaggcctttgatgactgagccttcgctagttttgtaataatcgccaagcagctggtaaccgccacagattgccagcatcggtttaccattttcgatataccggccaagtgtttgggcatggcgcaataggtctttggctaccacggtttgttcatagtcctgaccaccgccgaagaagataaaatcatagtcgtccgcattaaaatgatcgccaagactgacattatcgacatcgacttggtaaccttgttgatttaataaataacgtagaattttgacatcgccactgtcgccatatgtgttcatgaggtcttcataaagataagcgattttaattttatccgccattagccgggtccctccgtttgtttgactggcaacagcttaccacaagtgttggctgagaggaaagaaagtgcatagtgcgattttaattaaaaaaactcgaaacaggataagtgtttcgagttagtctggttattaacgtttgtgagccttaatccacggctgggctttttcctcaattgccttgtgaagagcatccatatccgcgtagtcactaatttcgaagacaaattcatctggctgatcgtggaaggttggcttgttgtttaacgtgatggtcaactggtcaaattgattatcgccagtatctttacgaatttgataagtgaaaaaggcagcttcatagttttgactattgtcaggttcctcgtacaaaacttccatgaattgatgttcagttcggtagttgtctttttttaacttatcccacaaagcctcatactgtttgtgcaaatcggccagctgggcatcggtcagttgttcattttctttgatttctttaccgtctaattccatttttctcgcctctgagtttagttaccatttcattatcgaactgtgaacgcgtttttgcaagatgacaagggaccgttcagacaaatcttgtggttgggtaattaggtgagtagtgcgaccgcagctagcccagatagcgaatcttgatttgagcagtaaggggcataataggtgtgtcaaaaaacttgcgcttaacgcctgttctttccatataaagacggttgagcagagaccgcttttacgttacacttgacgggtacgtgaaaccctgtttgttccacaaaatcaagtttacgaaaatggaggcaggcatggatccagcagcttttgtccaagccttggctgatcacgggatcgttttaaacgatcaccaacaggatcagtttgcggcatactatcagtatctgatcagtgagaatgaaaaaatgaatctgactggcattacagctgaaggggacgtctacctcaaacacttctacgattcactaacgcttgcgttggtgctacctgagcttcagacacaagtaatgtcagtttgtgatgtgggtgctggggcaggtttcccatcaattccgttaaaaattgcgttcccgcaactcaaaatcaccatcgtggattctttacaaaagcgaattggctttctagaacgattaacggcgcgtttggagctgacagatgttcagctctttcatgaccgcgccgaagcttttggtgccaaaaaatcgccacaccgtgccagttttgatttggtcacggctcgtgcggttgcggcattggatgtcttggctgagctctgtttgccactagtaaagccgcaaggtcgctttgtggccatgaaagccgcggcgacacccgcagaattaattgcggccaagtcagcgattggcttacttggcggcaaattggcccaagatgctgcgttgacgttgccggaaaccggcgatccacgtcatttgctggtcatcgacaaagttaaaccaacaccaaacaaatatccgcgcaagccggggataccgaataagcaacctttgggaggtgcataacgcgtgccattatcatccatttttggccataaaaagcctgacgacgaaacggttgttcaacaactgccaatgaccgcaatcgtgcctaaccaattccagccgcgcaaagtctttacgccggaatcgattcgggagctagcaacgacgatcaaggatcatggcttgttgcagccgattattgtccgtgaatataaaccggaaaagtacgaaatcatcgcgggtgagcggcgatatcgcgcgatgcaaaccctgggctgggaaaaagcgccagccattgtgcagaaaatggacgacgacgaaagtgcatccatggcactagttgaaaatttgcagcgcgaaggcttgagtgcgattgaagaaggccaagcttatgtggcacttatgaaactcaatcacctgacacaagccgctttggccgagcaactcggtaaaagtcaggcatttgtcgccaacaaaatccgtttattgaaactaagcgagccagttcaagaagctttaatgaagtcgcgtatcagtgaacggcatggtcgtgaactactgaagttagacgagaagcaacaggttgccgccttacaccagatttttgcagacgatctgaccgttaaagaaaccagcgcccttatcaatgagatgttgcggcctaagaagccaaccccaaaaccgaaacctaaagttcgacgatccgcggtgagccatgatacgcgcattgcttggaacacattaaaacgttcggttaaaatgatccgggaaaccggtatgacggtcacagcaaaagaagaagatactgacgacgcttaccgaatgatcatcgagattccgaaagaaaagagataggaggagctcatggcacatatcatcgcagtcgctaaccaaaaaggcggcgttggcaaaaccaccaccacggtcaatctgggcgcctgtttggccaaccttggcaagaagattttgattgtggacgctgatgcacaaggcaatgcgactagtggcgtcggcgttcaaaaggcccaagttgaaaaggatatttatgatgtgctagtcaatgaagagccgattaccgaagccattctgccaacgaaacataagaacatgtcgattgtgccagccaccattcaactggctggcgctgagatcgagttaaccagccaaatggcgcgtgaaatgcgattgaagctgggattgcatcctgtggaggatcaatacgattatattttgattgattgcccgccatcgcttggccaattgtcgatcaatgcatttacagcaagcgactcgattttaatcccggtccaaagcgaatattacgctttggagggcttaagccagttactaaacacggtgcggttggttcagaaacactttaatccgagcttagcgatcgaaggggtgttgttgacaatgtatgatgcgcggaccaatctcggcgcacaagtcattgacgaggtccgcaagtattttggcgataaagtatatgcaacggtgattccgcggattacgcgattggcggaggcgccaagctatggtctgccaattgtggattttgatccaaagtcccggggatcagaggtttacgaggctttagccaaggaggtgctggctgctcatggcgaataagaataacaaaggcttaggccgtggtatcgatgcgattttcaaagattttgagagcccagatctgagtgccaataatacagttgaagaattaccgctgattgacatccgaccaaatccctaccaaccgcgtaaaacgtttgatgaggaaggcttgaaggaactggctggttcgatcaaacaaaccggcgtgttccaaccgatcattgtccgcaagagtgtttcaggctatgagattattaccggtgaacgtcgcttccgtgcgtctaaattggctggcaaggagactattccatccattgttcgggacttcaatgatcccgaaatgatggaaatcgctgtgctggaaaacttgcagcgggaagatctgacgccgctagacgaagcccaggcttatgacaccttgatcaagcgtctgaatctgacgcaagcagaagtatcggcacgacttggcaaaagccgaccttatattgcgaactacttacgccttttgacactgccgcagcaagtcaaacaaatgttaagtgccaatcagctgtcaatgggacaggcacggacgctgttaagtctcaaagataagtccaaaatggtgagtgtggccaagaagacaatcaatgagaacctgactgtgcgccagctagaacggctcattaatcagatgaatgctggcaacacgcgcccggcaaccaaagaaaagccaaagtcgccatacgtgcgggcaactgagaaccaacttggcgaacgctttggcaccaaggtgaatattaatgaaggcaacaaaggcaaaggcaagatcgagattgacttcacttccgaaaaagatttgaatcggatcttggccatgctcgacgtcaatattgactaactagcagagcgtgagcagcccgtttagaaaccggagtgtaagcggccttggacgtgatggccgggtttttggccattgcgtccaaggtccttacacgcaggtttctgggccagcgaacgcgtttaatccggtccgacaagcacaacaacgctggaggtggacaaatgtatgatttacatgatctcgttcagatgaagaaaccgcatgcttgcggtaccaacaaatgggaaattatccgcttaggtgctgatatcaagatcaaatgtaccggatgcggtcatattgtgatgatgtcccggcgcgattttgaaaaacgactcaaaaaagtgttgggtcatgtagagtagacagactaaatagaaagtgtgaagtaaccaaatggctttaacagcaggtatcgtaggacttccaaacgtcggtaagtccacgctttttaacgcaatcactaaagcaggcgccgagatggcgaactatccattcgctacaatcgacccgaatgtcgggatggtcgaagtgccagataaacgtctggcacgaatcgatgaattgattccggccaagaagattattcatacaacttttgaattcacagatattgccggcattgttaaaggtgcttctaagggtgaaggactcggcaacaagttccttgaaaacattcgtcaggtggatgcgattgttcatgttgtccgagcgttcgatgatgacaacatcaccagtgtaactggcaaagtcgacccgttagaggatatggcgacgattaatatggaattggccatcgctgatcttgatgctgtcaataaacgctatgctaaagttgaaaaagtggcgcgaacacaaaccaatgacaaagaagcgcaggctgaattcaaggtgctcaaaaagattaagcccgtactggaagatggcgggatggttcgcagcatcgactttgataaagatgagctgaagattgtcaaaggcttgttcttgctgaccagcaagccagttttgtatgtcgctaacattgctgaagaagcgatggctgatccggattcggttgattacgtcaagcaaatcaaggccgaggctgccaaagaaggtgccgaagtgattgcgatttctgccaaaactgaagaagaaattgctgaactggatgacgatgaaaaggcagactttttggcagcagaaggtgtcgacgagtctgggttggataagctgatcaaggctagctatcatttgctgggattggcaaccttcttcacagccggtggcaaagaaacccgtgcgtggacatttagacagggaatgaaggctccagaagttgctgggattattcattccgacttcgaacgcggttttattcgcgccgagacaatgtccttcaccgatttagacaagtacggatctgttcaggcggttaaagaagcaggccgttatcgatccgaaggcaaagaatatgaagtgcaggatggggacatcattgaattccggttcaatgtctaacgcataacgacttaggagataggagtttccaatggcagagaaacatgaagcagagacgaaacagacggcaaccgatgctgcagtaactggtaaaaatactgctacgactgaacaaacagcatcaaaagtacagtcggcagccactgatgagtcgtcagcagatcaagcaacggcggctaaaaatgcacatgtgaaacaggaaaagcctgcgaccactgtgccagagctgattgcacggctcactaataaaaatgatgaatatattttcaaactacgccgtgagttaaaagacggcggtatgaacgcggcggatgaagaagaactactcaaaacgatgttgcccgagatcatcacagcgcaacgacaaggcaagccagccaatcagctttacggaccggttacggtaaaggcagacgaaattctgcatacgccaaaacctgagcctaaaaagccaatgtggttgatggtcattgaccaaagtctgttcttcatgtcgattttagcggttatgtatggggcacttgcctacttcgataccaagtcgcaaaacgccgccagcagcagttttgtttacttagtgatgttgagtctaatggctggtctcttcttcgtttattatgctgactggatgcagcaagataaaaagaaacgccgcagtgcttggcttgtcttgggcggcggtgttgtcttagtcgtgtcgatcacgttcattggcagtgccttggcgatgcttgacacgccgttcacgcgcccaatgccgtggttcgtcaatatcattattggcgccattgcctatgggattcactgggtcttacagcaccggtatcacctcaaaagctttttccagagataagctgatagtccgatttcaacatcgggtatctactttttaaaaaatccaacagtcgccgaaaatggcggcttttttgtattgccagtgagggaaaacggcaaatgttcttgtcattttacatgcgaaggttttagcgggtaaaaaacgaatgatattaaatgacgcgtcacaacacacgacaaaagccgaacattattttgagaaagctatagctgataaaattttgttcggttccatatgaacgattatgagactttctttcatttttaagcctatgataccggcgtttcgaaaaaaatggttagacttgtttgacgtgcctaaattccggtagtacattagtcaacaactaaaaattgaaagagggattacgctatgagtctttgggatacaaagtttgcccggcgcggttttacgtttgatgatgtgttgttgatacctgcagaaagtcatgttttacctcacgatgtcgatctgtctgtacaactggcggacaacttgaagctgaatatcccaatcatctcggcggggatggataccgttaccgagagtgctatggcaattgcaatggcacgccaaggcgggttgggcgtgatccataagaacatgagcatcgaagcacaagcggatgaagtgctgaaggtgaagcgcagtgaaaatggtgtcattgtcgatccattcttcctgacggccgataaaccggttagtgatgctgaagatttaatgaaaaaatatcggattagcggcgtcccgattgttaataacaccacagatcgcaagttgaccggcatcatcaccaaccgtgatctgcgttatgttgatgataaaagtgtgctgattgacacggttatgaccaaggaagggcttgtgaccgcgccggctggcacttcaatcgaagatgccgaagctattttacagtctcgtaaaattgaaaaattaccgttgatcgataaggaaggccgccttagtgggctgattacgatcaaggatattgaaaaagtggttgaattcccgcatgctgctaaagatgcgcatggccgtttgttggttgcagcagcggttggcgttacctctgacacctttgatcgggcgcaagctttgcttgatgccggtgccgatgcgattgtgatcgacacggcccatgggcatagtgctggcgtgattcggaaaatcaaagagattcgggaacagttcccattagcaactctgattgccggtaatgtggccacggctgaagcaacggaagcgttgtatgatgctggtgtcgatgttgtcaaagttggcattggccccggttcaatctgcacaacccggatcgttgccggtgtcggtgtgccacaactgactgccatctatgatgccgccagtgttgcccgtaagcgcggcaagacaattatcgctgacggtgggatcaagtattccggtgatatcgtaaaggctttggcagctggcggcaatgccgttatgctcggttcccttttggccggcactgatgaggcacctggccagttcgaaatttatcaaggccgtcgcttcaagacttatcgcggcatgggttcacttggcgcgatggcgcaggcccacggttctagtgatcgttatttccagagcggggttaacgaagcaaacaaactggttcctgaaggcatcgaaggccgcgtggcttacaagggcagtctcggcgatgtgattttccaaatgctcggtggtattgaatccggcatgggttatgtcggtgcaccgaatcttcaagaactccaagataatgcgcagttcattcaaattaccggtgctggtttacgcgagagccatccgcatgatgtgcagatcacgcgggaagcacctaactattccgttcaataaaagattggtatcacaaaaaggcgcgtactgccattggttgcagtgcgggccttttttggcgaacgcgctatgattaagaggctacattcgtgcccgatgaatcacgtcaagtagttccgtgccgaaagttgtggccaatgtcaatggccaagcgggattagtgggtacagttgtcagaatggtttgcagccattgtgcagttggcaaaagtttcactaactgatgactggagaattgcgtgaatagcaaattagcactataaaaatcaatcagactttgttgcaacttggcatcatggacaggtagcaataagtcattactattgttacgatcacccaagaaaagcggtaacggcgcaaaatcttgttgtaaactaaaaggggtcattttatgagtcgtggccatctcgggggtcaggcgcagcatgaagaccagtttacgcgacgctgtccacagcagcatgttggcaagggccgtgtcaattgctgtaaaggtatatgtgtttttggccgcggcaggactcgctaaggcttttgtcaacatggttatcgagtcgtggcgggctgatgatgctggtaagacaacctgtagctgacgaacacctcgtaaccaatggggatgtgtggcaaggcgtaaggtgagccattgggaggattgccttaatagccagtaagtacttccgcttgagcgggcaatgttaatgccagcgatgtgcatggttgagggtaaacttgctgtgaccatttttgtcaaatctttcaattagccgccttctttcgcgatcaaatcaacacttttgtacctattctagccctgttttcttaggcttttcgtaaagaattccccggtcaactttggtacaatggactttgatgtaacagaccctacagttcttctcataaacggagccaatacaatgaaaattttaattgttgacgacgataaagaaatcgtcgaattactaagtatttacgttaaaaacgaaggttacgaaccgattcaggcgtattccggtaaggaagccattactaagcttgtgaccaatcctgatattgctttgatgatcctcgatattatgatgcctaatatgtctgggatggatgttgtcaaagaagtccgcaaagattcacagattccaatcattatcgtctcggctaaaacagcagatatggacaagattcaaggccttattactggagcagacgattatgtcaccaagccattcaatccgctagaggtcatggcgcgcgtcaagagtttgttgcgccgaagtcaaaatgaggtgaccaatacggaaccggatgtgcttgaagtcggtccgctaacgatcaaaaaagatagtcatgaagtcaccacccttaccggcaagcaaattcagctaaccgcgctggaattcggcattctgtacttgctggctagccatccgaatcgtgttttctcggctgatgagatttttgaacgcgtttggcaacaggaatcaatcgtctcagcgaaaaccgttatggtgcatgtctcgcatctgcgtgacaagattgaagaagcgaccgatggcgagaaggtgatcgaaacagtttggggcgtcggctataaggttgaggcctaacgatcatgagtgaaaaagtcaaactaactggtaaggaaaaatccgaactttggattgaaggcatcgtaacggtgattctgctgttaatgcttaattttgccttgctggtgttgattaatcagatgatcgcgcacaatcctggtttggaaaatgctatctggggtgtgaaaacgaatctgacgtttggcagccgtggatttcatttgtggagctggtccaatcttttcctagcactgatggcgattgctgatgtcattgtggtgtattggcgacttgctcggcgatatcggcaaatgcaaatgcgtcacgtcattgcggagctacattttattgccgatggtcatcttgatcatcggattaagtttgaggtcaatacggagttgcaaaaggttgtcagcagcattaacgcgcttgttgattcaaccgtcaattcaatggccgaggaacggcggatcgaacagagtaaagatgagctgattactaatgtcagccatgatattcgaacgccgctaacgtccattatcggttatcttggcctgattgaagatcatcaatatcgcagtgaagaagagctactcaagtacacgcacacggcttatttgaaggctaagcagatgaaagtactggttgaggacctttttgagtacaccaaggttaaatcgaccacgaccaagctgaatcccgtacgttttaacatgattgcgatgctagagcaactggcagctagttttgagctggaggcgcataagaagcatatgcggattctggtcagcggggaacctgacccgttgatgatggaagctgataccgaaaaattaggccgagtgttcaacaatttaattgttaatgcgcttaagtacggccaaggcgggcgtcacatctttcttgatgcacaacgtatcggtagtgaagtcgttgttaaggtctcaaatgatggcgcacaaattccgaatgatgctttgagtcagttgtttgatcgtttttatcgcgttgaggaaagccgatcgcaggaaactggcgggactggtcttgggttagcgattgcccaaagtatcatcgctttgcatggcgggtatatttatgccgattctagcccggagataacaagctttgtgattcatttaccattaaaagttggcgcttcgctgacagacaataaaaataaatctaatgaggaagcaggaaagtcaaaatgaagaagttgatgcgcgggttgattgccgcagtggtggcggtattgatgattgggggtgctgcgccagcaatgtctgtatctgcggcagagagcagcgataccaatctagttgacgccaaggcagcagtagccattgaaccgactactggcaagatattatatgctaagaatgccagcagtgttttaccaattgcatctatgaccaaaatgttgagcattgagttggtgcttgacgcaattaagtccggtaagatcaattgggatgacaaagtgacactgaataacgcaatctgggaactcagtcagaatcgtgaccttagtaatgtaccgttgcggcgcgatggctcttattcagtccgcgaactgtacgatgcttctttaatttattcggcgaatgcagcgatgatgttattagctgaaaaagtagcgggcagtcaggagaaatttgtcagtcagatgactgcaaaactcaatagctggggtatcaccgatgcaaaaattgtcaacgtgaccggtttgaataacagccaattgaaagatgctaaggtacctggtacagatgataacgcggagaacgaaatgtccgcaaaagatatggcccaggtggcacaacatttactgaaagatcatccagaagtccttaagaccacgagtattgctaaacagacattccgtaagggaaccagtgatgcgatcgatatggaaaattggaactggatgctcaagggcctagtgtcttatgataagaacctcccagttgatggcttgaagacaggtacttctgatgccgctggggattgttttacagggacggttgagaaaaatggcatgcgaattattacggttatcttgcatgcaaatggtgatgctaaaactcgccgttttgatcaaaccaaaaaattgatgaccaatgttttggaaaattggaaaacgatgacgttagctgcagctggtcaggggattaaagggtacgacagcgtcaaggtcaatcgtggtcaatcacggacaacgccgattgcgccgtcaaccaaggctgttgctgttgtgccatctaacagcagcaaacaatcacttcaatatacttacacgccagcaaaaggcgtgaagaagaatactgtcgaagcaccagtcaaaaaaggtaccacgattgcgcagctggaagttagcgccaaaggtgacaaccttggctttgtcggcagttcagcaagcgaaggcattaccttaaagaccaccaagaccgataacaaagcaaacttctttgtcctgatcttccgtggcattggcgatttcttcagcaatattttctagtccagcagttacctcattgatccaaaaacgaaaaagtggtgaatgtcctgaactccgaatggagatcatcacgttcaccttttttgcaacaagtagagagttagttttcagataaaaaagaaggcattgaaatggtcacctatcacgagatcacgccaacaggtttggctaacttgaagcaggaagttgaagaccttaaaaccattcggcctgcaaagatcaagaacttggccgatgcggcagcgttgggggatcgctcggaaaatgcggaatatagcgctgctaagcgtgagttgcgccagctagaaggccgattgcgatatctggataaactcattcgttatgctaaagtcacgcacccggccgctagtgatattgccgatattggcaataggatcacacttaagttcgatgatgacgaggaccaagcgacttatgaacttgtcggccctgccgaagctgggatgggccaagacaagcttgccatcaattctcccttgggcgccgctattcggcagcaccacgcaggcgataccgtcacggtgacagcgccaagcggttcgtatcaggtgacgttaatgaacattgcatctgcataaaaaaagataatcaatgaactttgagcatgaaccaagacggcacacagatagttgtgacagtccgactggtttaatgccagtaccgcgcttatgctataatgaagcttgaattcacggcatataaaaaggagtagcagcccaatggcactatcacttagagcatgtatcttattattaaaggaacatcatctgctaaagagtgcagcaattcagaatactgaagatgtcgatatgaccggcatcgcctatgattcacgcaaggtctctggaccaacactgtttttctgcaaaggcgacaagttccgaccaatttatctttccatggccaaggacaacggtgcgcgaacttatgttgccgagaaaccttacgttgaaggcaacggcttaaacgccttgatcgtgcggaatattactaaagcaatggcgattttgagcgctgctttctttgattatccgcaagatgatttgtttgtggtcgcttatacaggaaccaaggggaaaaccacagcttcctattttacagaagctattttaaatgaggctcgtccacgacatatcgcgcttttttctacaattgatacggttgttggccctgagcccgatcagcgtttcaagtctaatctgacaacgccagagagcctcgatcttttccgcgatatgcgcgaggctgtcgaaaacggtatgacccatctcgtgatggaagtgtcgagtcaggcatatttgcgcaatcgcgtttttggattgacgtatgacgtcggcttcttcctgaacattacgccagatcacatcggaccgaatgaacatccaacctttgctaattacttacacaacaagctgcaattgttggtcaatgcgcgcaaagtggtcattaatgccgaaaccgagcattttgaccaggtttatgctgccgcaacgaccaccacttatccagaaagcatctacctgtttgccagtgctggcttcagacctaaacgcgatgatatcgatattgattttcgctttgatagtcaggaagctgacgttgctgagagtcggttcactttagtaccagtcacggaaaaagcagcagcattgaacatcggcggtcactactcgcttgctttgattggtgattttaacgaaagtaacgcgacggctgctattattggtgctggattggctggtgtggatgcatctgctgctgttccgggtattgcaaaagttaaaatccccggtcgcatggagcatacgaaagttgccggacatggtgctgtctatgttgattatgcgcacaattacgctagtatgaaggcgttattgtcgtttttgaaacacgcttacaaggatcctcgattactggttgtggttggatcccccggtgataaaggtgtttctcgtcgtcccggatttgctaaggttctcactgagtttgcaactgaggcattcttgactaccgacgatcctgggtacgaagatccagcaaacatcattgaggaaatcgatagtaaaatcgatcatagcaaagttaaagtacacaaagtgcttgatcggcaaaaggccattgctgaagctattagcgacagcggaccaaatgatatcgtggtggtggctggcaaaggggccgacccctatcaaaaggtacgcggcgtcaatacaccatggccaacagacatggctgttgtaaagcaagtcgctaaatcgctacaggaaggctgatacgaatgcgtcaatttttcaccgttattggcggcatgggcacgccggcaactgagagttatgtccgcttgttaaaccagcgtacccacgcgcatagcgatcaggaatatctgaattacgttctggttaacgatgcgactgttcctgaccgtacggattacattttggatcatagcaagcctagcttttatccggatttgttggaagacattcaagatcaaagtttgctcaatccggagttcatggtcattgtctgcaacacggctcattatttctatgaccaattagccgcagcgacaccgattccattgctacacatgccacatttagccatcagcgatatgtgtgagcgttttccaaatgaaaagcgggtgggattgattgcgacccaaggaacgatccaagacggcatttacagtcatgaaatcgaaactagcgggcgtgaagtcgttcttggcgatcaggcgctgcaagacatggtcactgagttgatttataaatacgtcaaggaaaagggcgaagtcaacgcggccctgtatcatcgtattcttcaacggatgcatgatgattttaatgtcaacgtcattgtccttgggtgtactgagctatcgtttgcacaggaaaaagccggtgatcatccgtatcatgtgattgatgcgcaaagcattattgttgataaaacaattgcgttaggcaaagctttccgtcaaagtgaagcagctggaaaggcattgttgaatcaaatgatggcgcgttaatagcgtgttaaaagaagatgcttggttttgctagatgtcttagcaaccaagcattttttgaatgctaagaaagacgattgatcaggatatcgctatttttgactgatgcaagtgtgacgctaggctgctaacacattcaatcaactacttacttgtggtaagcttatagtagtacccagtaaaggagatgctcattttggcacatttaaccaaattgaccgacacatatacattaagtaatggtgttaagattccgatcgtcgggttcggcacttggcagacccctgatggcgacgttgccaagcatagtgtcgaagcggcattggctgcaggctatcgtcatattgacacggcggctgcttacggtaacgaagaaagcgttggtgcaggtttgcgcgcatccggcgtacctcgcgatcagatcttcttaaccactaagctttggaatggtgatcacggttacgaggcgactaaagcagcgctagataaatcactcaagaaactgggcgttgattatgtggatctatatttaattcattggccaaacccaattaagttccgtgataattgggaagaaactaatgcagggtcatggaaggccatggaagaagcgtacaaagccggaaaagttcgagcaattggggtttcaaacttccgcgccaagcacattgacgctttgctaaaaacagctactgtcaagccaatggttaaccagattttcttgaatccaagtgatttgcagccagaagttgtggcgtataatgacgcccatgatattttaagtgaagcgtacagcccacttggcacaggcaaaattttccaagttgatgccttaaagaaaattgccgcacgctatcaaaagagtgttgctcagatcgtcctccgctggtcattgcaacatggtttcttaccattgccaaaatccgttcatgacgatcggattaaggaaaacaccgagttgttcgactttgaactgagccatcatgatatgaccttgattgatgctttgcacggtgaagccggcttagcaactgacccagatacaacggatttctaaggcaaacgtctatataaggggattcagtgtaactgattgcttaatgatcaagtattcctgatgaacttataaataaaaaatgacttcattccaaattttggggaatgaagtcatttttgtttttattgtgtgtcaggtgaatgcagcaacagctgattgaggcgttcaagtagatgaaaagcagggttatttatcggctgactcggaaacgatgctgcctgtttgtgcattaattagctgaacgtcattttcagcaagaaagtcgacatacttgggcgcaatgtcgccataggtgataatggcatcaatgtctttcaaagtaccgtaggtcagtaatgaaacacgatcaaacttagtgtgatcgattaacagtattttttgatgcgcttttttaaaaatctcagatttaatcaaatattcgttatattcagagtttgacagccctctagtaatagaaatgcctgttgctgccataaaggctttaccaatattaaagcgactgaaaatattcatattgtcaattcctgtaaaggactgggttcgtcgatcaaaattcatgccaataatgaccaacttaatattcccaaggggagcggctttattaatgatctctaaattgttagtgacgagtgtaaatgaaaactcggaaggtaaataggcgcccatttcagccgttgttgtaccagagtcgatgaaaatcaaatcgtctggttcgattaattgcgcagcggctcgaccaatttgacgtttttcggagggagcagaaagttgccgttcactgtagatggttagcgcgttgggcttcgctctgttaaaggtagcagtgacaccgccgtatacttttttgacagtaccagcatcgattaagttagcaagatctctacggagtgtgctaggggctatagaaaatttgtcttcgagttccctcatggaagcagttctgacttcgttaatataatgctgcatcgcatcaattcgttcttttctaagcatggatgtcaccttcctttctaaacaattggtcaacctgattatagcataaggcggtcaacttaatgaccatattttgactaaaagaagaacacctatttattgattaagtgactttatcaataaattgagagtttggctaatacaatcaagcctgaatgaattcaaccgcgtgattttcgtcgttgtctcagacatgatcaatagcatcgattagaatcatgcgaaaccaagttcctaaaaaatctagaaatcgtgattcttcgtaggcaaggggatggccacaaatgaacgtttaaacatactgcattttgagtggtagcatgctgaataactgtttgaactgacttaatcataccatcgtgcgaattcacatttcatcttttaagacgtatatagataaatggtgaacatgttgtgaacaagtgttgagtacattttagttgactttgatctgattaaactctatgatggcaatgtgatcataaagtaagcgcttaattcgttgctcttataaagctttagtcagtttggagggtttaagaaatgcgcaaagaattagaagccgttgcgaacaaagccgatgttgcactcgctgcacaaaaagaagcggctatgctttcggaaaaactgcctaagtcagctcgtaaacgactacgcattatttcagtgattgccacttttggcggcatgctgttcgggtatgatacgggtgtgattaatggcgcactaccatttatgacgcgagcaagtgaacttaacatgtcgcctggaatggaaggatttgttgccagctcattaacacttggtgctgcattcggtgcagtgctgactgggagaatctcggatcgaaaagggcgccataaagtcatcactggcttagccatgttgtttgtcgtttcaaccattgcatctgcgttatcaccaaatgcccctatattagctggtgttcgctttattctagggctggcagttggcggagcttcggtgatcgtgccaacattcttggctgaggtggcgccatcgaacctgcgcggaagaattgtgacgcaaaatgagttcatgattgtgtcaggacaacttttcgcctttgtctttaatgctattttgggcacaactttgggacacattcccggcatttggcgatggatgctcgtattggcgaccataccggccatcattttatggataggcatgagctttgtgcctgagtcacctcgatggttagcagcaaatggtaaattggatcaagcgttaaaagtattgcgtgaaatcagaacagaagcacaggctaaagatgaaatggaaaaaatcaaaatttcattgaaatcagcgcaggaagttggaaatgcttcgattaaggatttaaagatttcctggattcggcgcttggtcttaatcggcattgggttaggcatcatgcaacaaattgtcgggattaatgtcatgatgtattacggcacgacgattttgcaaacaactggtttcggacaaaatgcggcattaattgcgaatattttaaatggtgttacgtctgtcgttgcaaccattgtgactatgcatttgatgagcaagtttaaacggcgacagatgcttttaactggtatcagtggaacgttgttttcgctggtcggcattacgttaactagccattttctaaatggcagtcccttgttaccttatgcgacaattctgttgaccatcatttatttagcctttttccaaggagctttagggccgctaacttggttattattgtcagagatttacccagcccgtcttcgtggattgggcatgggctttgcgaccttcttcttgtggatcagtaacttctttgtcggttatttcttcccagttatgttggcaggactgggcatgtcgaataccttcctagttttcgttggcgccaatattctctcattgatctttgcttggaaatttgctccggaaaccgcaggcagatctttggaagaaattgaactggataataaatacgatgacaagtttcctgaagaaagtcagattaacaagaactagctaagcatcattttcggaatatttgaaagcgctttaatgagtgccgttacttctgcattgaagggagaaactcgaaatggatacaactaagcaaaatgttaagacgctaaagaattttatcaatggtaaatgggtggatgcaaaaacagaaacttttgagaatgtttataacccggccactggagatgttttggcgcgagtgccacattcgactagtgaagacgtagcagatgctgttacggcagcaaaagaggcttttaagatttggcaaaaggtttcaattccaaagcgtgcgaagattcttttcaaataccaacaattattggttgagcaccaagaagaacttgggcgaatcgtcactgaagagaacggaaaaagccttgacgaagcagttgctgaagttggacgaggtattgaaaacgttgagtttgctgctggtgtgccgactttgatgatgggagattcattgtcatcagtggccactgatgtagaagccacgaattatcgttatccaattggggttgttggcggcattacgccatttaactttcccatgatggtgccttgctggatgtttccaatggctgtagcaactggtaatacgtttattctgaaaccatctgaaaaaacaccgctaacgagtcagcggttggttgaactttttcaagaagcgggcttaccggatggcgtgctcaacatcgttaatggtgcggttgatgttgttaatggcattttagatcatccagacatcaaggccattagtttcgttggttctgaacgtgtcggcgagtacgtttataaacgaggcagtgaccatttgaagcgggttcaggctttaacgggagccaagaatcatacgattgttctggccgatgccgatttggatgcagcggttaaaggcattattagctcctcattcggctcagctggtgaacgatgcatggcgacatctgtcttggtccttcaagatgagattgctgacaagtttatggcgaagtttacgcaagcggcaaaggatatcaagattggcaacggccttgataaaggtgtcttcttgggaccggttattcgcaaagaaaatcaagagcgaacattgaactacatccaaacaggggtcaaagaaggcgccaagcttgtgttggatggttcagcagaagccaagaaacatgatgggtattttgtcggaccgactatttttgaagatgtcaaaacagatatgaccatttggcatgatgaaatgtttgcgccggttctctcggttatacgggcaaaggacttgccacaagcggttgcgatcgccaacacgtctgaattggctaatggggcgtgcttgtttacagattctgcggcttccatccgttactttagggaaaatattgatgcaggcatgttgggtatcaatttaggtgttcctgcaccgattgcagtgttcccgttctctggctggaaacattctttctttggcaccttacatgctaatggtaaagacagtgtggacttttatacgcataagaaagttgtgaccgctcgatatgatcagcggcgtttcaagtagacgatgaacaggataagggtaagacacttacaagggggattatcatgagcctgttatatcacaagcaaaatcaggaactgtcttcaggtgttcggctgattcaggatgtgaatgcaagcaactcaccgatgaaatatacagccgtcaaggttctggaattttctgcagatagttcgtatgaagaaaccttggaagcattcgaagctggcattgttgtgctggaaggcaaagtaactatcactgctgacgatcaaacttttgaagatgttggtcaacgaacttcgatttttgacaaaatccccacagacagtgtgtatgtcagcacgggtttagcatttggtattagggccaagcaggctgccaaaatcttgattgcctatgcaccaacgaatcaaacgtttccggttcggctaattcgagggaatattcatcaggttgaacatcgcgggaagtacaacaataaacggcttgtgcagaatattttgccggacaatcttccttttgccgacaagcttttattagtggaagtttatacggactcggcgaactggtcgagttacccgcctcacaggcatgatcatgatgatttgccagcagagtcactgttagaggaaatttattatcatgaaatgcgacctaaacaaggattcgtttttcagcgtgtgtacacggatgatttgagtttagatgaaacgatggctgtgcaaaatcaagatgttgttgtggtgccaaagggatatcacccagtgggtgtacctgacggctatgacagttattatctcaacgtcatggcaggcccgacgcgtgtctggcattttcacaatgcgccggaacatgcgtggattattgatcggcaataagtaaccgagattatttttaaaggaggtaaacttcagatgccacaaaaatttgatttgattgccattggacgtgcagctgttgatctgaatgccgttgaatataatcgccctttggaagatacgaaaacttttgcaaaatttgtgggtgggtcacctgccaatattgcgataggatctgccaaacttggacaaaaagttggctttattgggaaagtctctgacgatcaattaggccattatgtcacgcaatacatggctagtgtgggcattgatacgtccaacatggttaaagatgacacaggacacaaaattggactaacctttaccgaaattatcagtcctgaagaaagcgatattttaatgtatcgcaatgaagcagctgacctatatcttaatgcgcatgaagtttcgagggcatatttggctcagactaaaatgctagtcatttctggaactggattggcacaaagtccttcacgagaagctattcttaaggcattgttaatcgctaaagagcttggagtcgaagtcatcttcgaattggattatcggccttatacttggcagaatgccgaagaaacatctttgtactatcaacttgtggctcaaaaagcagatgtcatcataggaacgcgtgatgagtttgacgttttggaaaatcaccaaggccggacagatcaagaaaccattgccacattattccaatatgacgcgaacttaatcgtcattaaaagtggcatacaaggatccaatgcttataccaaggctggcgaaacttaccacttcggtgtcttcaagacaaaggtattaaagagctttggggcaggcgattcttttgcggcgggatttctgtacgcctatcagcatcagttaggccttgaaacagcgcttaaatatggcagtgcagcagcctctattgtcattagccagttaagttcttcagaagcaatgcctaacttagaccagctaacagcgttcatcgaaaaggccgaagctcaggaggtgcatcagtcatgactgcgacggaattaaatgcacaagtagctgcagatgctaaaaaagaaacgattcgactgactacagcacaagccttggttcgttttttgaatcaacaatacattgatgtcgatggtcaagtgacatcatttgttgaaggcctgtttgccatctttggtcatggtaatgtcttgggcttgggcgaggcgttgcaggaagatcctggtcatttgaaggtttaccaaggacacaatgagcaaggaatggctagcacggcaatcgcttatagtcggcaattatatcgccacaagatatttgcagtcacggcttcagcaggccccggatcagctaactttgtgacggccgccggtaacgcatatgtcaatagcatcccaattctgtttttacccgcagacacatttgctacgcgccagccagatccagttttgcaacaaattgaggttgactacagtgcagatacgacaacgaatgatttgttgaagccagtatccaaatattgggatcggattgaacgtcctgagcaattgatgagtgcgctgctcaaagcttttgaagttttgacaaatccagcaacggccggccccgtgaccatcgccttgcctcaagatgtcgagggccaagcctatgattatccactcagcttttttaagaagcgtgttcatgttgttaaacgggttcagcctagctcagccgagttggctggagcagtcgaactgattcaagcaagtcaaacgccagtcttgattgtaggcggcggggcaaagtttagtgatgctggagctgccattgaaacattttctgagcgatttaacattccgattgtagaaacacccaccggcaaatcagcgatttcttcagattttcctaataatatgggaggtactggtatcttaggcactgccgctgccaatgcagtcattaccaaagcggatttgattattggggctggtacccggtatacggatttcacgacagcttctaagacagcaattcacccggggaaaacgcaacttatcaatattaatttgaatcgcatgcaatcgtataaatttgacgcttttccaattgtggcagatgttcgggatacgctcagtcagctgacagaaagtttatccgattaccgaagccagtttaccgacctagcaaccattaaagaggcgtggcaaaaagagcgtcaacgtttggcacacacaaattacgatgctccggcatatgtacctgaagtcaaaaatcaatttgatgctaaaacgatggccgcttatgcagagaagttgcaaacacacctaacacaaactgaggcagttattgccgttaacaatacgattgatccgacaagtatcatcgttgcagctgcaggttccttgccgggcgatgtgcagcggatttgggatccagtcgtaccaaatacgtatcacatggaatacggctattccatgatgggatacgaggtgccagctgctttgggtattaagctggcccaacctgatcaagaaagttacgcattagtcggagatggcagctttatgatgcttcattccgaactagtgacagcactgcaataccataagaaaatcaatattctagtctttgataattcaggctttgcttccattaataatttgcagatggcgcaagggagcaacagttatctcactgaatttcgcactgcggacaacgatattatgaagaccgattttgccaaaattgctgaaggctacggggcaaaagcttatcgcgctaacgaccgtaaaagcttaattgcggccattgaggacgctaaaaagcaaacagtatcaactttgatcgatatcaaagtcttaccaaagacaatgactcagggttatggccaaagttggtggcgcgtgggagtttcagaaatttccaataatccaaaagtgcaaaaagcgtatcaggatattcaaacgggtattgataaagcatttaaatattaaaggagtgacaaatatggttgtcaaagttggtgtgattggaacaggtgctatggggcgagcgcatattgatcgactgacaaatgttctcactggtgcagaagttgtcgctgtcacggatattgatcacgaggctgcagaggccgctgtgagagattttcatcttaacgctaaagtgtacccagacgacactagtctgctacaagatccagatattgatgcagttttcgttgttagttttggcggggcacatgaggcgactgtcctgaaagcgttggatactgacaaatttatttttaccgaaaagccgttggcaaccacattagaaggtgccaaacggattgttgataaagaactgacaaagtctaaaaaagtgattcaggttggcttcatgcgtcggtatgatcagggcattcgtgcacttaaggaaaaattggacactgggatcatcggtgcgccattagttgtccgagcgagtcatattaatccaaatgtagccagcaattattcaaatgaaatggcgattacggataccttgattcacgaaattgatgaaatgcattggctgctagatgatgaatacacttctattcagatcacttatccaagacaatcagcagaggttaggaatgaaggcttgcacgatccgcagttggcaactttgacaaccaaaaaagggacagttattcaggtgttggttcatgtaacggctcagtatggttatgaagttaagctggaagtgatcggcgaaacaggcgaactgcagttaccgaattatggccttggaccgattctgcgctcaaatgctaatcagcaaacggctgttgaaatgagttggatcaaccgatttattcaggcatataacactgaagttcaagaatttattgatcaggttgctaaaagcgagccaccggtcggaccgagcgcatgggacggctatattgccgctattacggccgctgctgcgaatcggtcacagaaagatcaggaaactgttctcatcaatgtggccggaacaccaactttttaccaaaacaaaaacgcgattcatgcatagtcttgcttagacaaaatagaaagaggtaattgaaacgatgactcaaaaaacgattaaaatcggcattgttggtttgggacggctgggtaaaattcatgcgacaaacattgcgacgaagattcagcacgccaagctgcaagcggcgacaagtgttgtacccgctgaactggactgggcaaaaaaggaactcggcgtcgaagaggtctttgaagattttgacgacatggtgcaacatgcggacatcgatgctgtcttcattgtttcgccgtcaggatttcatcttcagcaaattgaaagcgctttaaatgctgggaagcatgttttcagtgaaaagccaattggcctagatattgaggcaattgagcatacgcaacaggtcattgcgcaacatgcaaacttgaagtttcagttaggctttatgcggcggtttgatgactcctatcgttatgcgaagcagttggtagatcaaggtaagattggtgatattaccttgattcgcagctatagcattgatccggcggcggggatggcaagtttcgttaaatttgcaacatctgctaatagtggcgggttgttcttggatatgtcgattcacgacattgatgtcattcgttggtttaccggcaaagagattgacaaagtttgggcgattggtcttaaccgtgcctatcctgttctggataaagccggcgagttggaaacaggtgcagccttaatgcaactagaggacaaaacgatggccattttagtggctgggcgtaatgccgcgcatggctaccacgttgaaactgagattattgggactaaagggatgttacgcattgctcaggtgccggagaagaatcttgtgacagtcatgaatgaggaaggtattatacgcccgacttcgcaaaacttcccggaacgctttgcacaagcctttttaagtgaagaacaagcttttgtgaatagcattttgaataaccaggatgtcggcattacagcagaagatggcctgcaagggacaaaggcggcattagctttgcaagaagcgtttgaaaagaatgacattgttcaagtagcgtctgtagacaaaaaggtaggtgcttaaagtgacgattgaattgggtattgccccaatcggctggacaaatgatgatatgcctgaattaggcaaagaggttacatttgaacaagccattgatgaaatgacgttggccggttataaagggacagaagtcggcaataaatatcctaaagatccgaagactttgaaacactttttggatcttagacatttgaaaattgctagtgcatggttcagtgcttttttaaccactaaaccatacgaagaaacagaggccgcgtttattaaacaccgagattttctccatgccatgggcgctaaagtgattgttgtcgccgaacaagggcatagtgttcaaggtttattagacaaatcggtttttgacgacaaacctcactttaccgacgatgaatgggaacgtttagcaacaggattggaacgattgggtgatcgggcccgtgaagtcgggatgcaaatcgtttatcaccatcacatggggacgggggttcaaacaactgcggaaatcgaccgattaatgacaatgaccgacccggacaaagtatcgctgctattcgatacagggcatttggtgctttctggtgaggatccattgaccatctttaaccggtaccaagatcggattaagcatattcacttcaaagacgttcgccaacagcaggcagacgaagagcataaagatcatttgagttttttagcaggagttaaaaatgggatgttcactgtgccaggggatggcatgattgacttcaaaccgatttgggaagctattcaagaaagtggttatgatggatggattattgttgaagctgaacaagatccagccaaagccaatccttttgaatatgcattaaaggcgaagaaatacctggatgcaacgatgaatattcctcagtcagcataagtgtagaaaggacatggggaaaatggcattagtttctgcgacgtcattagtggcatcggcattggcagatcgttacgcaattggtcatttcaatattaatggtgctgattggttagagacgtatctgaaagttgcacaaacgactaagacaccgatcattgtcgccacttccgatcgtatcattgactttctaggcggctttgactatatggctcgctacgtacggtttatgatgcaagcgctcagtgtgacagtaccagttgctttgcatttggaccatgggttatcagttgaccatgtttatcaagcgattgatgctggttacacgtcggtgatgtttgatggttcaaagttgcccattggcgaaaatgtggccttaactaaagaagtcgtagcatatgcccatgcacatcatgtttctgtcgaggccgaagttggtagcgtaggtggtaatgagaatggactcgtcaatgggattcgatatgcaagcgttgctgacgctgttgagatggcttcaacaggtattgacgcattagccgcggcacttggatccgttcacggtgattacgtcggtcggccaaatctgaattttgaacgcatggccgagattgcagcggctactaaattacctttagtgcttcatggtgcgtctggcattttagatgatcagatccaacaggcgattcagttaggcactgcaaaaatcaatatcaatacagaagttaatacagtttggacgagtgctgtgaccaaagccctgcaagccaaacgttccaatcatgacccgcaaccaattttaactgctggtaagcaagcaatcgcgtatttggtagaagcgaagatgaaggcatttcatgtgttagggaaaagtactcgcctatcttctatgagttgatgtgaacaacaaatttatccaagagggagagattaagatgccactcattcgttttgatatgatcaaaggccgatcacctgaagagattaaggacattttacaaattgctcacgaggtcatggtagcagcttttgacgtgccaccacgagatcgttatcagatcgttcatcaacatgagccttatgaaatggtcgtcgaggacacaggattagatattccaagaacagatagggtcattgtcatatcgattgtgagtcgagtccgaaccattcgacagctaaagaaattttatcaagatttagcagataaattggaaactgccggattagtggacaagaatgacctcatgattaacgtttcattcaatgatgatcaaggctggagcttcggacaagggaaggcacagttccttgaaggtagtctgtaacgacaattgaattagaagcaaacgcaatatcgttgaccacttacgcaataaatctgaattggttacgatcagtgttcaacggatttctaaggcaaaatcagcgatattaggtttttagttttttccatgagaaaagcatctgccatgaggttgcggcagatgcttttttatatactttgaaagattgggcaagggcaaggcggtgagctcaagcgcttagtgccgcgttgcatcaattgttgctcttacttggcggaaaagcggtgctgtctgactatcggttttgatggcactgatcataaagagcgtgtccataatgctgatttcggcaatcagtgcatgaagcgcctcagtgcggtagcgtgattcttcagcaactgcaacaaaggcagcatctgccattttgactaagcgcgaagttggggaaccggtaatgacgattaaaggcacttgttgtttcttagctagttcagctaatgcaatggcatctttgtcctctcctgaatgcgatgtcaggatcatcgcatcgcgcgggctaagatgtgtggcggccattagctgcatgtggtagtcagccgcataggccacgggaatcgccgtgcgcaaaaatttatggtaaccgtctagtgcaacaagattactggcacctagtccaaaaagtccgagatgctcggcatgggtaatccatttaacagccttggtcaaagcatcagtatctaggtttgctaaggttgttctcagtgcatcaatgttggaggtgaaaattttttgcgctagcgtatcaacggaatctttgggactcaactcagcaaaaagcgcatgatcatcctctggtgaagtctgcgccaacgccatgcgtaaggcctgaaagtttgtgtaacctaaggctttagcaaagcgggaaatcgtcgctgtactgacgccggtcaattggctgagttccgagatgttggcctgactggcatggtccgggtgggcttgaagataggcagctagctttttctcctggccacttagattcggtttataaatttgcagttgtaccagaaagtcatgcatcttgatccctcctaaaaatacattcaccagagcagaaacgagaatgtcagaattttaagtcgcattgtcagagtgcgtttattgtctaaggctgatggttaattgcaccaagcgaaacaccacttttcgaattcagtatagcatgaatgataacggtgtgaaaataatttacggtcaaattacttgatttttgtaaacgatttacatacaatggcatcaggatataagataaccatcacagaagcggcttgtttttttgaaaacggatggtcacagggtcaaataacgaggaggcagcaaacatgcatattggcatggttggtttaggaaaaatgggtatgaatctggtcgcaaatatgcgcgatcatgatattgaagtgacagcatttgatttgaacgacaaagcgcgagaagcggtagggcaatatggggccaaggcagtggcaagcctggatgccttagttatgagcttggcatctccgcggatcatctggagcatggtgcctgctggcaaaccgacagaagccacgattagtcagctagctaaactgttgcggccagatgatattgtgattgatggcggcaactcctattatcaggattcaatcgcacacggaaagctgctagctgctgagggaattcatttctttgatgtcggcacttcaggcggcatggccggtgcacgcgccgatggcaatttcatgattggtggcgacaaggcgatctttaacaagattgagccgctgttcaaggcgatcgctgcaaaaggtggctatctgtatactggcccagctggatctggtcactatttgaaaatggttcacaacggtattgaatatgggatgatgcaggcgattggtgaaggcttcgatgtgttagcccacagtccgtatgactacgacaatgcggcggttgccaacatgtggaacaatggctcggtgattcgcagctggctgatggatttggccgccaatgcctttaccgaggatgcgaaccttgaaaagattcagggtatcatgcacagttcgggtgaaggtgcttggaccgttgaagaagccttacgtctacatgttgcaacgccggtgattgccagttcgttgatgatgcgctatcgctctgaagaagcagatacgatgacgggtaaagtggtcgctgccttgcgtaatcagtttggcggccatgcggttgatccaattaagtcaaaataacttgcagaaccatcgtgatatcgccattttaataactagtggctgcttaaaaattctataattcaggcagttaagctaatatatgcattattgcggtataataaatccattggaattagctgttttcctgcattttccttgcattttttgggaacctactcggaggttatcgtatggtctatcgtcacagcccgcttcaattgtcatttgaatcctttggtgccggtttaagtaccccacttagctctaacaatgagtggatccagttggcggaggtcatgccctggaaagctctcgatgaggcataccaattggagttcaccaaaaatgcgggacgtgcggcaaaaccatttcgtttactctatggggcaatcctgatccaacaacggatgggtttaactgatcgtggggtggttgcggcaattcgtgatacacccgcacttcaatatttcatcgggttgtccgaatacaaagcggttgagccgttcaattattccagcctggcacactttcgcaaacgaattgccgatatctccgagctgattacgaatatcatgaatgatacagtacgcgccaagatcgaagcgttggtcccattcaaagtggacaccgtcatcacggacgcaaccgcagtgccagtcaaaatcaagtatcctcaagacaccgtcctcctcaaccaagcaaggctgaatcttgaggcgatggcgatcgatatggcacaccaacttggtgtgccaaacccacgcatgtacaaacgcgaggcgaagcattgttggacctcattttcacgacatccaaagcaacagcgtggtggctttcataaacaggtcaaggcccaacttcaatatgtgcgccgtgatttgcggtacatcaacgaattcatcgatcagggtgcgactctaccagatgaacaagcgattcgcttaggcgtgattcgaattctatttgaccagcaatggtacatgtatacccacaagactcaccacgttgaagaccgaattgttagtctccaacagccgtacattcgcccaattcaacgtggtaaggccaatgctaaagttgaatttggggcgaagattgactgttcgttaagtgaaggcgtagtcgacattgaacgttttgatttcaccgcattctctgagggccaagacttcgcggaaactttagaccactattacgaccttcatggacattatccggatgaagtactggccgatacgctgtaccgtaatcgggagaacctaaagctgtgtaaggatttgggtatccgaatctgcggtccgaagcttggccggcatccaaaacacgttgatgcagcgaaacggcgtgaggatactgatgccgagaatcgaagaggtaccattgaacgccggtttgcttttatgaagggcacgctggggcttgacttggtgaacactcggacagctgaatcactggccgtcaagattgacgcggccatcgtcttgagcaatgtgctgaccctgttaagggtatttgctataccaattttaattttggctaaattcgagggtgaggcctatcaaattcgctataaatttactacaagggtcgaagatatggcggcctagttcaacagccactaactaagtcaaaaattgattaagtaaaggagataagcatggcaatcaaatatatgattggcgttgatctgggcactactagcacaaaggtcgttttgtttgatctcaagggtcacgcaattgcaaccgctaacaatccctacccgttatatcaagatacgcccgacatggctgaggaagatccggaagagatttttgcagcgacagttggcggtttaactgaagtgatgcatcgcggtaatgtccaacccgatgaacttggtggggtttccttttccgcagcgatgcacagtctgattttgatggacgaaaatgataagccgctgacgcgcgtcatcacgtgggctgataaccgagcagcagcctatgcaacgaagctgaagcaaagcgatttagggatgacactgtttaaaaatacaggtgtgccgacgcacccgatgtccccattggttaaattgctttggttgagtgccgaacatccagaattggtcgctcagacttcccactttattggcattaaagactttattttgttccgcttctttggccgatatgtgcaggattactcgctggctaacgcaactgggctctttaatattcacaccatggattgggatgaccgtgcacttgatgttgccaatgttcggcgcgatcaattgccagaactggtcgacaccagttatcagttgacaggattaaatgccaactatgcggcggtgaccggtattgatgctaaaacgcctttcattctcggtgccagtgatgggacattgagcaaccttggcgttggcgcgattgatcctggtgtcttggcggtgaccattggtacgtcaggtgcagtacgggttgtgactgacaagccggtagttgatccgcaagggcgcctgttcacttactacctgtcaccgaatcactgggttgttggcggtccagttaacaacggtggtattgtcttccgctgggttcgtgatcaactttttgcaccagagaaattaacggctgagcaactgcaagttgattcctatgaaattctgacagaaattgccagcaagatacccgctggtgctgatggcttacttttccatccatatttaggcggagaacgggcaccgatttgggatgccaatgcacgtggcagtttctttggcttaacccggcagcatacacgtgcgcatatggtgcgagcagcacttgaaggaatcgtttacaacctatatatggtgatgctgatgatcgaaggtatcactggcaaaccaaaagccatccaggctactggcggatttgcgcgcagtgcactgtggcgccagatgttggctgacgtttttgaacaggaagtcaatattccggaaagctttgaaagttcagccttgggagcagttgttttgggaatgaagtcactgggactgattgacgatttgaacgtggttaaagatatgattggtgtcaccaatacccatgaacccaatgctgacaattttcaagcttatcgtgagttgttgccaatctggattcgattgacgcgtaaacttggcagcgagtatcaagcaattgccgactatcagcgggcgcatccagatccgaatgcccatatagctgctgaggattagtcgccagcactgcgcctgttgtccgtgctaagacggaatatgctggttcgatgggaaaatagcgagaatgaagcaactgggtacacagatcaaacgacatgtctcgagaaaaacgtcaatgaacgtttttcataaataaaattgtaagcgatttcttaatctgtaaaatttagggggaatagaaatggatatactcgtcctggtcttaggtatcctgctcttgctggtgcttatcatcaagtttaagttcaacacgtatgtttccttgatcatcacagctgtcgtcgttgcccttggtttgggaatggcgccagccaagattgcgaccagtattcaaaatgggattggcgcgcaactaggtgagctggccttggtcttcggcttcggtgccatgcttggtcgattggttgctgatgctggtggagcttaccgcattgcgcataccctcatcaatgccttcggtcgccgcggattgcaacttgccgttgttttggcatctttcattatcggtattgctttgttctttgaagttggaattgtcttgctggttccaattgttttcgccattgcggctgaagcaggcgttccaattctgacacttggtatcccgatggcagcggctttgtcggtgacccatgggttcttgccgccacatccagctccaacggcgatctcgactgcattaggcgcttctgctggtctggttttggcctatggcgtgatcatcgccattccgactgtttatattgccggaccgttgttttccaaacttgcgcatcgctttgtgccagatgcttttgaaaggcgcggtaatttgaaagcattggggccgcaaaaaacctttaaattggaagaaacaccaagttttggcatctccgttctcacatcacttttcccagtgattttgatggcgattgccacggtttatgaattggtatttcatggtggcaaacttccaaagataccaaatggtcttgataacgttatcgcattcattggttcaccaagtatcgccatgctgatttcattgttgttcgctatgtgggcaatgggctatgcgcgcaagctgccagccaaagccattatgacaaccctcgaggacgctgtgaaatcaattgcgatgttactactcgtcattggtggcggcggtgccttcaaacaagtcctgattgatggtggcgtcggcgactcagtaaaaaatttgttcgttggctcaggcatttcaccacttatcttgggttggctgattgcggttgtcttacgaattgcactgggatccgcgactgttgcggccatgacagcctctggactggttctgccactcatgcaaagtgctggcatccagccagctttgatggtactggcaattggtgcgggttcattagctgccagtcacgttaatgacgccggtttctggatgtttcgtgagtactttgatttgaccattaaacagaccttgttgacgtggacattgttagaaaccattatttcagttgttggacttggtggggtgctgttgttgagtttggtggtttaagtgaagaaataaaaaaagctggcaatgccggttttttttatctgtttcaagatgaaatgaggatggataagttcttagagatactgatggtttggcactatccgacccaacttagtagaccgcggtcaccgttttcctgtcaaaccggccagcattcacgaagattaaaatgatctcgattcgcccgactgaccacaatatgataaacttacgccattcgctaatacagaaatggagatcgtttacacatgtacgaaccaactaaaaaacgccgcgttgccgaagacgtggccaaggttttccctaaagaagtcaccaatcagatttttgatgtgatcgctgtgatgaataaggctaagcaaattgtgacagcaccagtcgccattgcattttcggatgattataccgatgatgaaatgtatgccatgatcattcaaggcaatcttgcaccagcacaagagtttccgcttacctatgctggcgaaaagccatttttgggtcatgggtatatccttgtggtcaaagataagccgaaaacaattcggctggatttcagtacggctaatccgtttaaggcagaagaatccaaataaaactggccttttcatgaaaagttcgatacaatagtaaaccgtaatcgttaccgtttactattgggaggcagctatgagcgaaccgattttgaccgtggatcatctcagctttggttttcgggatcaacagctttatcaggatctgagttttcagttgaatgtgggctcaatgacaagtcttgttggtccgaacggggtcggcaaaacaaccttaattcggttactaatggcgcaactaaaaccgcaagccggaacgattcgctttcggcaacagccaccggttcgattgggttatgtgccgcagttccggaatgttgatacggaatttccgttgtcgatccgcagtttcattcaactccggcagttggatcatctctttttctggcatacgggtaaggagaaggctgccttggatgccgtgattaaagcgactcaccttggtaaaattgctgatacgcggcttggaatggcgagtggcggcgaaaaacaaaaggcttatctggcacaagctcttttagatgatcctaactttctgattctggatgaatcaacggccagcttagatgtcaacacgaagcaggagttgatggatctggtgcaggagttgaatcaaacgcggcaattaacggtgctatttgtgacgcatgatctgagcttagccaaaaagtacacccaacaatacttactactgaccgggtcaagttatgagatgaagccaacagcgcaaatggatttgaaagcaatgccagaagaattacgcaatgatgccgagaatcgtggggtgatcgcatgaatttatttgcttatgcattcatgcaaaatgcattcatggcaagtacgtttattgccattaccacaggcattgtcggtgtgttcgtcgttgcgcggaacatgtcgttcttagcccacacactttctgaagttgggtttgcaggcgctgcgtttgcggtgtttgctggcatcagaccgttagacgggatgttgttgttcacagcgatcagtagtatcagtgttggccgcatgtccgttcaagcatcgcggcgagaggcctcgatcagtgcggtttccagcttgtttattggtttaggaattttgtttctgtcactttccagcgccaatgctagttatgcaaccaccattttgtttgggagcatcatcggaatctcccgcgccgatgtctggcaactggtggcattggccgccggcgtactaataacgttgtattttggctatcggcgtctcgcgtttgattcgtttgatccggttggttcggcggcgcagggattgaaaagtaaatatatttccatttactttctgctcattcttgctgtttcggtttcgattggagcgcaaattgtcggaagtttgttggtctttatcttactgaccttaccgcccaatgtcgctaagtatctgggtcgaactttaccgcagatgattgtgatttccgtcattaccgctttaatcggggtttggagcggcttgtatttaggctttttgacgaactggccggtgacgtttttcatcgctgccattgaatttcttttttatttcttggcattgtggtaccatcaccgaacaaactaagcaattgaaaaaggactcgcaacacaaaccgtattgagtagcggttgtgttgtgagtcttttttgacgtagttagtgttgatggcgatatttgtgcagaaattcagcaacttcctgttggtaatcgtggcgctgttcgaattgtttgaggtaagcagcattgtgagtgctggtggcgccagtgtggcgtaacttcgtgtaaacctcaggataaggtaactgctgttgcttggctagtgataactctgcggacacgtcgtaaggcacctgccgcagatcaagatcggtgatggcaccatcattgagttgcagcaatgcatagtcggcgtaagtggttgtttgcaggtgtggccggggtgaataggcttggccaatagaacctggattgaggatgacttgaccgttactggtgtagcgcagtagctgttggtgggtatgcccataaacagctagatcaatttgcgaatctggggcaatttggtcaaagttgagttgtggttgatcaggatataaggcatgtccatgatttttgtcaggaaggttgtgtgctagactgacgatcaaaccatcttgctcgaaaacttcatgcagcggccaatttcgaattgttgccagattttcagccgtgaggtgcggccacagataggcaaccagtcgactaaagtaaacatctgttggctgtgacagatcaactggtccatccagtacccagaataaatcgtcatcccagttgcctttaacaatatgtgtgggtttgagtccttgcagcgtcgcccataacttatcagaacctggaccgggtaaaaacagatcgcctagaaaccagtattcatccacttgatgcgccttcgcatcctgaatgaccgctgaaaaggccgtcatattgccgtgaatatccgataaaatggcgattgtcgtcatgcttgatcccacctgtcgttcatcgtaatcaacccttgcgttccgaggttgcccttaccagtattaaccatttgttcatacagctgtttggccaattgcgtggctggcagttgtaagtgcatgttatcggcttcatccagagcaatgcgcagatcttttagaaaatgttttgcaaagaatcccggcgtatagtcgccttgcaggatacgtggtccgtagttgctgagactccagttggcacctgcgccaccgccaaccactttaagcgtttcgtcaagatccaggccagcagccttagcatagacaagcatttcggtaagaccggtcatggtgccagcgatcatgatttgattggccattttggcatgttgccctgagccggccgggccaaaataattgactgaggcggcgatgggcgtgaaaagttgctgcaatcgcgataacaaagtcttgtcaccaccgaccatgatggttagcgtgccatttttggcgccgatatcaccaccagaaaccggcgcatcaacggcttgcaggcctttctcggcagccttagcagcaattttcttcgccagagtgggggtactggttgtcatgtcaatgagcagtgccccttttcttgccccagctaaaatgccatcgctaccaaaataaatggtttcgacgtcttgcggaaatccgaccattgagagaacaatgtcgcactgcgcagcaacagcgtgcggcgattcggcccaagtagctccagcctcaatgactggctgtgcatgggcctgcgttcggttaaagacgaccacttcttggccattctttaaaaagttcttgataataccggtgcccatcacaccggtgccaataaacccaagtttcacactgctcatcctttctgcaaaatttcttctaattcagcgagtcgttgttcaaatagtgagaaggcggcttctaaataatctggcttggtcatatcaacgccggccgctttcattgtatcaatcgcatacttggaactgccagatttcaagtagccgatatagcgggaaaccgcctctggttcgccaccgctgatgccggcggccagagtcgaggcagcggcaaaaccagttgcgtactggtaaacataataattgtaatagaaatgtggaatacgagcccattcaaaggcaatttcaggatcacgtgcaacatctggtccgtaataacgggcattgagatccgcataataggaggacatgctggttgccgtcaatggttcaccatgctggtcttgttgatgaatccaatgttcaaagtcagcaaattgagcctgacggaagaccgttcctttgaagccgtctagatagtaattcaaaatgtacgcccgaactttaggatcattggtgttttttaggaagtagtccgtcaataaattttcattggttgttgaggcaatttctgcgacgaagattgggtagtcgccataaacgtaaggctggtgatgacgagtgtaccagctgtgcacactgtgaccagtttcgtgaaccaaagtgtacaattcatcaacggcatcgtgccagttcagtaaaatgaacggattggtgtcatacgcgccaccggaataagcgccggaccgtttgcccttattttcgacgacatcaatgtaacgattattaaagatttcccgcatatgatctaaataatcatttcccagcggagccaatgcctttaaggcttcgtcttttgcctgatcgagggtgaaactcaatggcggacgtccggtcagcggtgtgtagatatcatacatatgcagttgatcgacattcagaatctttttacgtaaggcaatatagcgatgtagtaatggcaagtgagcgttgacttgatcaagcagtgttgtgtagacactttcggggatgtggttacttgccattgcagcagcgcgagcatcgggataatgatgcgctaaagcattgaagttatgagctttgatctggccactcaatgtttgagcaaaggtattcttaagactttcatatgcccgcagcaaagcctcaaacgcgtctttacgcagcttgcgatttgttgaccgaatgagttggccatacaaaccattgctgagttgcacggtctcaccgtcttcattttcaacaaagccaaattgcaggtcggagttgttcaacacattaaaggttgcatgactggcattcagcgcatccccagcactggcaattaatgactcagccgctgtggtcaggacgtgttggcgattcacagtgatggcatcaataaagtggccatagggtttgaggctttcggtatcgcgccaagcggtcagctgatcggctggaatcgccagaatttccggatccatgaaggctaattggctggcaagatcagctgccagactttctgctttggcattcatggcttgatacgctgcattgccagtgtcttgatcacttttcaagctggaatagacataaaccttttcaaagcgtctgaacaccgcgagaacggctttgatacctgcgacaagtgcttcaggcgacttgcccaatgtacccttaagtgctgccgcttcctttgcttgctgacgaacggcttcaaagtcaacttgccaagccttgtcatctggataaatagtcgtgagatcccatgtcaattcggtagggacttctgcgcgtgccggtaaatgttgcatctaatcagctccaatttctaatatttctttaatgttaccatattgaggcggcatttgaggtaaatcccttttttcttcataattatctgctaaactactctggaaactaaaagtggagtgaagctcgaatggacaagcaaccagatttagatcaacgaacattaaaacgcaaaccaaaacgacgtcatccgattcttcgtgcgttggctgtcatagctctcgttgccttttttctcgctggtggatatgccgctcgattttattctcaagccaaaaaagcagttgcaaaaacgtatgatccagttagtactaaggcagtcagctcagatctcgatggcaaaaaaccgatcagtattcttctattaggaaccgataccggagcctttggtcggaaagataccggtcgatctgacaccatgatgctggtcacaatcaatcctaaagagaagaaaacaacgatgaccagcattcctcgtgacacgctggcagagatggtcggtactggaagcgactcgccgacatacgagaagattaatgcggcgtatgcgtatggccaatccgatgcagctattaaaacagttgagaagttattagatgtaccgattaattattacgtcacggtcaatatggcaggcttatcaaaaatcgttgatgctgtcggcggtgtggatgtcaatgttccgtttagttggacagactggaataccggaggccaaacctttaaaaaaggaaaggcgcatctcgatggcgggatggcattggcatacgcccgaatgcgtgacgaagatcctgaaggcgactatggtcgacaaaaacgtcagcaggaagttatcaatcaaatcgttaaacaccttttatcggtcaaatcgttgacaaattaccaaaaggtcatggattccttatcatctagcatgcggaccaacctaacatttgatgatatgatgtcaattgcgcaaaattatcgcgcttcagcaactaccattgatcgtcaacagcttaaagggattggcgtttatattgatgaggctgcttatcaggtgatgacaaccgaaacgcttcaaaagatgtccaatgagctgcgtgggcagttagggcttgaaagcaagacgctaagtaattttaatactcagcaaaatgaaattaacaatgcgaatggatttgattggacagcgaacaatccggtctacactgtgtcgctcgatggtgcgacaaccggaccgtgatcaaaaaaacagcagcactctggcttcattgccaaggctgctgtttttttgtgagcgcgagtaggagcgctcaggcttctgcgactgggagcgcgtcatggtgaagcgctatactgaatattttttgcctgatgagaaatcaagacgtttttaatctggatcaggcaaatccggggccaatttgtgaccgctaagtttagcggcgatgaaccccgaaagaaagccgatgagcagaaatggcacaaaatccatcccgatgccgaaccaaggaatatagattgtagcgaattgttgaatgctactgaaaatcggtagttgtgctagcccagctggtaaggcatggatggcatctaaaagcgcagggatcatcgtgaaggcaaccgtagttttatagattcgggtattttttccaatccaaggatgcatgaggccgagcatgattaaggcaattgccagcggatagagcagcattaaaattggcgttgaataagcaatgatctgatccaacccgaaattggcaatcaggaaagcaccaattgtcgtcattggcaggaaaaagtgatagccaagttttggaaaacgatgaccgagatcttgcgagaaggatgtcacaagaccgattgcggtggttaagcaggcaagcagcgtcatcgcgcctaacaaggccgtgccaatcaaaccggtataatgtgtcatgatctggttaaacgccgtcccaccgtttgctgtgagcttagagaagccaagactgattgctcctagcaagatcaggagcatgtagatcaaagcttccaagcccatggccaaggagcctactttcgcaacagccttggcgcgagtggatgcctggtgcaagcccatgagtttcaaggctgtgatgatcgtcacaccaaagcctaacccggccagtgcgtccattgtgttgtacccttgcaaaaagccgttaatcaagttgctactcatgagcttagggctgctggtaaaacttatcgcacgaatatcacctttgatgaccagtgcccaaaagaagatcactgctagcaaaatcaacaacagcggattcagcagcttgccaatataagtcgtaattttactttcgttgcgagcaagcaagaaggttgttaaaaagaaaataaacgagaaaatcaaaaggccgatttgttgttgaccttttcctaagaacggcgcaatgccaattgagtatgtgacagtagcggtacgcggggacgcgatcagcaggcctagactagcgtgagtggccagcagaaagaacaatgcgaagctatgtcccgctggccgagcaagatcgtacatactactcgcacgggttagactgatcgccatgattgacagcagcggcaacaacacagcagatagcaaaaagccaattgccgctggtagccaagctgaaccggccagttgacccatgtggatcggaaaaatcagattgccagcgccaaaaaacataccgaacaaaagtgaccctagtgtcaaatactggcgctttgtgagtgtgggttgtggtgacattgatatccctccatttaatcaaaacgattgccgacagcgtcttgactgtaagaaggttttcaaaggagttggctaattaaccaaaagaaaagcccttaacagtctcgactgttaagggcgcgaatcacgctgtaccaccttaatttaccgctacgtcaccgtaagcggccttaccgtgtacggccagttgcctggcgatacacgattgctataatgggcgcaatcccaaccgaagcttccaaagtcacctcggcaactcgtagactactttcccaaagctaccagaggtctcttcccaccaaccgagactcgctgacaccgacaactcaggtactcttctactcatcgtttttagtcgtttgttgaattgttgtttattttacgaaaaaaacgacagatgtcaactaaaaagttcagagcgcaaacaggcgcgtttagaaaccggagcataagctgccccaagcctaaatggccgggctttggcatttaggcttggagtccttatgagcaggtttctgcgcctgtttgcgcgttttgaaacctccgagatcaagtagtcccttattagtcaacacggttctaagcaaaatttgcgcaaacaaaaaccctccgcactgatgcgaagggttaaagcaatctattaacctacgacttcaaccgtcgcagtcaaaactccagctgaaggaatctgtgaattcggcattgcaacatccaattgattagggttgccagctgcaaaactaccagtatcattaacagtccgataccaaacagtgccatcagataatgtaatcttcagacgggtacctttcgggaatacggagaggttagcagcaacgccgccgtaacccaaaccagacccaagcacggacggatcatagaaacttaacttgaaagtacctttgttggtggttgtttccgtcgaagctgttgtagcagcgcttgatgaagcagaagcggctgaagcagcagatgctgccgcagcattttgagctgcttgttgtgcttcctgttgtgctttttcagcagccgcctgttcagcagccgcttgttctgctgcagcctgttcagcagctgcttgttcttcggcagctttagcagcggcagctttttgatcagcaatctgatgtgctgcttcggcaatatcattcgtgccgactgtgaacgtgatttcttttttaggattgatcagtgaatgtgcattcgcctgttcaactttagcctcattgcttaacacaattgactttgcgtttacgtgactactatcgttatctgcatcggcgtgatcggcaatcgcttcgaccttttgtgaatggttacttgccatccctaataatggtgcgaaactgagtaacgcgatgatagataatttaatttgcttagtaaagataaatattcactcctaatattttgaatagtcgtcgttttgttcccccgagaacacaagacgaagtatataggggtggtatgtcagtaaaataccaacatcattacaaatatactcaattcagtaatattgttacgttcgtgtaacaaacggaatgttaaaatttttcgtaacaatcagtgaacttttctcgaaaaagtgggttgagaccttgaagttactgtgatattggccaattttctaccacaatttgtgaattttttggaaatttatgggagcctaaactttaactctgatcgttcatgatacaattcaatgactagcctaaacggtgcttttgagaatcaggtataatgaagctgaactgtcaaggaggccgaattcgtggcaatgtatcgggaaaaacgttttgaagagataaaaaaactgttggcagcacgcagcgagttgagtatcgaggatattatgaaggcggttggtgtttcacgagataccgcacgccgagatattgttgcgcttgatgcgcaaggcgttgcgagacgaactcgtggcgggttggtgtctcttagctttggtcacacgattcccagctactctgcgcggctgaaacgattttcaactcagaaaacaaagatggctaagtcagcattgacgttaatcaaacctggcggcgtttatttcattgatgattcgacaaccttattaaaattgtcgcagtccattcgacaaccggtgacagtttacacgcacagtttagacaatgcgatcgcactctcagttgaagaacgtgttaatttacatctttttggtggcaaactggatcatcacgcccggttcttctttgaaccaacgatgcttgaaacacttcgccgaatcgcctttgatgcggcatttatcggtgcaacggctattgccgaagatggggtttacttttcctatatggaagatgctcaggtgaagcaggcagcggcgttatcagcacgccgggtggtcgtggtttctgaaaccgaaaagtttcagattgaagcgccttatcgcgggctggaactcggccagattaccacacttattacggataaaaaattatcgcgaacgcacaagcaatggtttgccccacagacacagtttctgcttggcgactaacaactgcttgactaaaaagggattgatacctattcaacagctaataaatgatccggggattcgcacgagtgaggaggtgcgttcatggtaaagccactcgtcaccatcattgtgccggtttataatcttgaagcctatgtggctcacggcttgaaaagcttaattgaacaaacttattctcatttgcaaatcattgtgatcgatgatgcctcaaaagatcattctccgcagatcattgcgcatttcgcagaactggattcgcgtattcaaccgattctgaagcaggtgaatcatggggtttcggctgcacgcaatagcggcttggccctagccaaaggcgatttagttgcttttatggatggcgatgactggtacgagccggactttattgctcacgccgttgacatgatggcgcgtggctgggatctcattgcgatgccgttttatcgggatgatcctgacccgcgaccggtgcatgaggctttacgcaagcctaagcagctcacgcgggaaggcctaattcggcaaatgcttcatccaattggttatattcgcggttatttatggaataaagtttttcgacgtgatgtcatcgagcaagtaaggctacgttttgatgaaagcatgacaattatggaagatgaactgttcacggcgacttacgtgatggccactcaccggtttctttacaccgggcatccagcttatcatcatgttgttcgtcgagactcagcgacccaatcgttggggatcatcggtgcggttccgcagcagctatatgcgctttggcggattcatcaagttttacgagtcgcacgacgaacagaaaaggtcactaagaaagaggcaattaagattgaacattgatcattggaggcgcgggcgttgacagaacatttaatgacttatcgccagcttaagcaaaaagcaaaagggcaattaaaagaaggcacgaatcggcgcgatttgatgctggcttatttgttaccgagtttaattcaggcagctgtcgctatcatcacgtacttgatggtcttcgccttaattcaaaaattcggcattgacaaagctttgactgatccagatggattccagaattatctgcaaagtggcaatcgtaccggaagtatgaatacgattcaaagcttggtcaatacgatgctgattcaaggggtcaattttggcgtgctagatcttgtacgccgtaaagagcgagttcaaccactgcatgcgctgctaggcctatttaacggtcagtggttctggggtgccatctcattatggatctttatgtatttcttgacgttgatggggctgtcatttttcttgattcctggaatactacttgcattgggctggcgtcaggccttttgggtctttaaagatggtcatgaaaccaatcagcgcttttcctcgatatcggcgttgatcggttcttggcgactgatgcgcggcttcaaaggcgatttgctcggcctgtatgtttccatgatcggttggtatcttctggaaaacatcacgttccatttatttgactgggcgatcaatccatacttgcaattggttcacgctaactattatgaaaatcggcgcgcttacaagatcgcggctcaagcggctcaatcatgactaaagctgaatcgttgtcgccagctgcgagacggggtatactgaccgcgatctcaacaaaatgaattgtatatcggtattagcattttgaaggtgaggcaaaagacgatggaaactgaagcctatatgacacttgccgaagtgaaagctcggcaagccgccttaaaagataaagtaccgctagatcaggctattgctgaaaatattcaaaactgggctcagtggttgcttgatgaaggtttcgagggcagttacttcacggctaagattgacggtgatactatcaacattaccgatttagatggccacccagccgccagcatcagcaccgatgcgccaagttacgtcgaagcatttaaagcctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaatacatcgccgcgaccttaggccgctctcgtatttctattaggcatgagcttcaccgttgccctgaaggtgattactgcgccattatagctcaggatcatgccgatacttgtcggcatcgttgtggtcggcactcgattttaacgcctaagttgaagcggatggtaactgagaagctaaacctaggttggtcccctgaaatggtcggttatgccgttcactgtgcgccacacacgatttaccactggatttatcaaagacaagtcgattttcagccaagccaactctttgatcacggtaaacgtcataaaagaagacaagaccttcggtcgcgctataaccaagcagtaggcacctcaattgagattcgcagtgagtcagctaatcggcgaaccgaaaaaggacatttagagatggatacagttcgcggtggtcgcgggtcaaaggctgctgttttgaccattgtcgatcgggtgacacgtttaatggcgacaactaagcttgaaaacttatcacaaaatgctgttctcaagggatttgcaagactgatggtggactttccgggtccggttcgatcagtgacggttgatcacggtaaagagttttcctgcgatcaggcgcttacaaagcgctatcggataccggtttacttttgccacgcctatcacccgaatgaacggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggaaagacagtgatcgcatgacgatgatggccattcaaaccaaactacgcaggttgatcgatcggcaggttttaaagtcgcagtgagcgcgagccagcgcttttagaaacaggagcctaaatggccggttaggttcgaggttcttatgtgtaggtttctgcgatggcgagcgcgttatagacagcaagccaagcatcaaaaagcaagccaaaaacgaaaacgaccgcagatcaatcaagctcgtttaggctcgagtcacttatatatgagctccggtagtgacaaccaaacaacgtttcacccaaaagcaccgccagtcgctaaccattaaaaggttaacgactggcggtgcttttgagtgctttgtcagactagtaaagtttcatctgattcaatggccaatagcgccaaacaacaactgattgaatttttgacttatcaacaaatccaaaatcgcggctgtcatgggatactagccgattatcacccatcacgaagtatttgccggctggtaccttagcagatttcgttgaggaaagggttttgatgttgaagtcattggtgaatttaatcgttgaagcatcaagtccctgctgactggcccatttattaatctcgtcggtggcaaactttttgttcaagtatggttcggcaatcttcttgccgttcactgacaattgattatcttttgaactaacggtgtcaccaggcatgccaatgacacgtttaatatagagagaaccaggccgatcaggggcattaataaccacgatatcgtttcgcttaggctttttgacgcggatagaatacaaacgatcaccgttttccaaagtcggttgcatcgaagttccttgcaccacatctttgctcaacacatagcgcatcagtagttgactggcaaagaagataacggcaaaaaggacaaggaattcgagcaccgtttttaaggtggaatgactgttatttttcacaatgacaccttccggaacagaataacttcagtctaccacaagccgaacgctcgcaactaggaagatcaccggtcaatttaatcgtattttgggaaaaagccgctattttcggcttgccggcataaatcgacaatttgcgcatattcggctaacatcaggcaccaacgatgaggcaaacttgtatacccgtatgcaagtccagctaaaccgccaacaagcgcgccagttgtatcggtagcgccaccttggttcacggtttgtaagacggcatcgtgatagtccggtttactttgcagtgccttaagtgtgcgtgctaacaaactgatcggatcggtagcactcccatcaggccacttatcatctgccaaggctgcttgaaaagcttcaaaaattggctggtaaggctgcgtggttccaaaataactacctgctttgtcgataccagtggcaatggcactcggtaaatctggcgtcgcgccaagtaattcaacggcaatttgcatgtaaatgccagcagcaaccaagttttcagcgtcttggttagtaatatgaacaaaagtttcaagtaccttaacaccttcagctttttgaaaaagactcgtgtcaaaagtttgataggcgaaaaaggcgaatggcaagattcgaatgagtgccccgggttctttggcggcggcaactgattggccagttttaagtgctgtttcaatgcttggccagatatccggactgcgtttgccataaggagcatacttacccgcggtgaaccaagcctggtaagccttgattaaggcttgttcatcaaaaccgtgctgcaaggcatctaatccgactaacgcgagtccagtttcgtcagagtaggtgccagcaggttggttaaaggtgccataacccttcatggtggtcaccggtgctgcggttaattcagccgcattttgtcccttaactggcaatcccaacgcatcaccgatcgcaaaaccaacggtgccgtgaatcaagcgtgattccatgatacccatttaggttccccctctatgtatatgtcgtgtcgtgattttgacattttctcaggtcatccgaagcatacttaaccttgtcaaagggcagaccacatataaattctttgatattactatggagctattatttcgctagaacgcataaaattgcaaaaaatttgctccgttgtaaaaataaccatgctgtgatagcctagcaagcagtgactattttcagaaagagcgtgaataagggagccagagccagtgtcatcattgtgtcaattggcattgaggccacccgcatgcaaactgtcacagcttgcgaagtggtttcagcaaacgctctaagcaaccaatcagctgtcgttttttatacgttttagtataggaggaatcatgagtgttcttaccgtaaccggcctgtcacagcgctttttagacaaagtgttgtaccaagatgccagttttcaagtaaatatcgaagaccaccttggcgtgatcgggcaaaatggggtcggcaagagtaccctcattaagattctgacaggggcactgacgcctgatgcaggtaaaatcgtctggcagaagcacttacatgttggctatttggatcagtatgcgaatcttgtacccggccaaacagttattgaatttttgcggaccgcgtttagtgatctctaccgtaaagaagcaaaaatgaatcagatttatgccgattatgctaatcatcccgatgacgatttactggccaaagcaggggagctgcaacaagagcttgaagcgggcgatttttatgatctggaaacaacgattcaaactgttgctgaaggccttgggattacagcaatggggatggatcatcctgttgaagcattgtctggcggccagcgatcgaagttaatcttggcaaaattattacttgaaaagccggatatgttgctcctggacgaaccgacaaactatcttgatgtgtcgcatattgcctggctaacggactggctccaaaattttgagggcgcgtttatcgtgatctcacatgattttgattttctagaaaatgtaaccaatgctgtcttagatattgagttcgggcaaatcacaaaatacaccggaacgttaaaacaagccatgcgccaaaaagaggccgatcatgagacttatttgaaggcttttgccaagcagcaagagacgattaagaaaactgaggcgtttattcggaaatttaaggcaggcacgcgcgccacgatggctaaaagccgtgaaaagcagctggcgcgaatggacaaattgacgcctcctgggacgcgatccaaggcgcatttggcgtttccgtatgcgcctgttaatcgacaaatcttggtggatgttaacgatttggttgttggctatgacaagccattattacaaccaatgaacttttcggttgcaaaagatcagatcattgctttcgaaggcttcaatggtgtcggaaaatcgacgttgttaaaaacattgctcggccttttaccggcgatcagtggcaacgttgaaatagctgacaatgttgtttttagctactatgaacaagagttgcactgggatcaacctaaacaaagcccagtgcagtatttggagcaacggttcccagcgctcacgcagaaaaccgttcgacaggtcttatcacgcactgcactgaccagtgaagaggcgaacaatcctctgacgatgttgtcagggggcgaacaggctaaggtcaagttggctgacctaatgctccaaacgactaatattctagtgatggacgagccgacgaatcatttggacgacgacaccaaaaacgctttgcgtgaaggcttgcaacaatatcctggcgcagttttactagtttcccatgaagctggcttctatgatagttcctgggttgacacagttgtgaacgttgaacagttgcaagttaaagcttaacgtttcgaaaaaatcaacggcgcatgaccatcaatgatgtttatgctgttatctataaaaagacttgctgctgtatgaacgttcatactggcagcaagtctttttttagtcggaattcggataattcggtttgtgtttcgagcatactgaatgggtggtgattaaacatgccagaccagttgggtataagtataagtcaaccgatcagtcacctgaacgtgcgtattctcatggccggtgatggtcttggcaaggctggcagcagttttaagaccaattggtgtcgccagatccggtaacaagtcgcttaaagttgtttgctcttcaatttcgtatgtcaaagaatgactttgaaaaggtatccgttgggctgtcagccaaactttgaagcttgtcatccgggcggggtccgcctgataaactggtggtagctgcaatcctaaaagcgaggccgcttgttcaagcaaagcgtcagactgtgcagtttgaaagttaagcaccacggtttggttagcccagttcatcagcatttttaggtcttgaggtttaagtgtcggcaactggctgacaaacaacatatcggcattaagcggcttgtgtaatttgcgccagtcagccacgataaattgagctttagcatcggcttgttgatgcatgcgctcttttgcaaaggcgagcatggcagacgaccaatcaatgagcgtcagttcctgaacccatggcatcatttgaacagcgtagcggccagttccggcagctaagtcgactgccgaatgcgcaggcagcaattgcgttgaacgcagccatgcgatgacatcgtgtgcgataggcaaacgcgacgcctgctctgccgcggcataatcaggcgcaaatgcgttccaaaaagcttgatcctctgtcatagtgcgtgcttttcctttcttgaaaaactttttttaaaaaagtggttgacttgagtgagtaaactgcgtagtatagtacgagttgtcagtcataaaaacagtttaaaccgcacagcgatttaaaaaaagatgttgacaacgagttgccaatttgatattcttagtaagttgtcgcttggcgacaaagtggtcctttgaaaactgaacaaagtttcgtttaaatgtgcagggtccttggtacttcggtaccgaggcaagaagtaacatttgcgaagtcaattcgctagaacaacaaatcgagctattcgaacagctcatatttatatgagagtttgatcctggctcaggatgaacgctggcggcgtgcctaatacatgcaagtcgaacgagttctcgttgatgatcggtgcttgcaccgagattcaacatggaacgagtggcggacgggtgagtaacacgtgggtaacctgcccttaagtgggggataacatttggaaacagatgctaataccgcatagatccaagaaccgcatggttcttggctgaaagatggcgtaagctatcgcttttggatggacccgcggcgtattagctagttggtgaggtaatggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagtcgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaaacagactgaaagtctgacggaaacctgcacacacgaaactttgtttagttttgaggggatcaccctcaagcaccctaacgggtgcgactttgttctttgaaaactggatatcattgtattaattgttttaaattgccgagaacacagcgtatttgtatgagtttctgaaaaagaaattcgcatcgcataaccgctgacgcaagtcagtacaggttaagttacaaagggcgcacggtggatgccttggcactaggagccgatgaaggacggaactaataccgatatgcttcggggagctataagtaagctttgatccggagatttccgaatgggggaacccagtacacatcagtgtattgcttgtcagtgaatacatagctggccggcggcagacgcggggaactgaaacatctcagtacccgcaggaagagaaagaaaactcgattcccatagtagcggcgagcgaagtgggaagagcccaaaccgagaagcttgcttctcggggttgtaggactggacattggagttaccaaagtccgacgtagtcgaagtcagctggaaagctgcgccacagaaggtgaaagccctgtaagcgaaacgtcgaaccctccgtccaggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaacagttcctgaaaccgtgtgcctacaattagtcaaagcccgttaatgggtaatggcgtgccttttgtagaatgaaccggcgagttacgtttgcttgcgaggttaagatgaaaagtcggagccgtagcgaaagcgagtctgaacagggcgaatgagtaagcagatgtagacccgaaaccaagtgacctacccatgaccaggttgaaggtgtggtgaaacacactggaggaccgaacccatgtatgttgaaaaatgctgggatgagttgtgggtagcggtgaaattccaaacgaacttggagatagctggttctctccgaaatagctttagggttagcctcggaggatggatcatggaggtagagcactgtttgaactaggggcccatcaagggttactgaattcagataaactccgaataccatcgatcttactccgggagtcagacagtgagcgataaggtccattgtcgaaaggggaacagcccagatcaccagttaaggtccctaaatttatgctaagtggaaaaggatgtggcgttgcacagacaactaggatgttggctcagaagcagccaccatttaaagagtgcgtaatagctcactagtcgagtggcactgcgccgaaaatataccggggctaagcataataccgaaactgtgggtgcgcccgtaagggtgcgcggtaggagagcgttctaagggcgttgaaggtcgatcgtgaggacggctggagcgcttagaagtgagaatgccggcatgagtagcgaaagatcagtgagaatctgatccaccgtatgactaaggtttcctggggaaggctcgtcctcccagggttagtcgggatctaaggcgaggccgagaggcgtagtcgatgacaagcaggttgagattcctgcactagtttattttgtttaagcgatggagggacgcaggaggctaaggaaagcgcacggctggaaatgtgcgcccaagcagcaagtctgacagcgagtgaaatgcttgcagtcttaaggacaagctgtgatggggagcgaaattatagtagcgaagttcctgatgtcacactgccaagaaaagcttctagtgagaaataaactacccgtaccgcaaaccgacacaggtagtcgaggagagtatcctcaggtgagcgagcgaactctcgttaaggaactcggcaaaatgaccccgtaacttcggaagaaggggtgctgactgcaaggtcagccgcagtgaataggcccaaacaactgtttatcaaaaacacaggtctctgctaaatcgtaagatgatgtataggggctgacgcctgcccggtgctggaaggttaagaggatgagttagcgcaagcgaagcccagaattgaagccccagtaaacggcggccgtaactataacggtcctaaggtagcgaaattccttgtcgggtaagttccgacccgcacgaaaggcgtaatgatttgggcactgtctcaacgagagactcggtgaaattatagtacccgtgaagatgcgggttacccgcgacaggacggaaagaccccatggagctttactgtagcttgatattgagtgtttgtaccgcttgtacaggataggtaggagccgtagagatcggaacgctagtttcgatggaggcgttggtgggatactaccctagctgtatgaacactctaacccgcgccactaatcgtggcgggagacagtgtcaggtaggcagtttgactggggcggtcgcctcctaaaatgtaacggaggcgcccaaaggttccctcagaatggttggaaatcattcgcagagtgtaaaggtataagggagcttgactgcgagactgacaagtcgagcagggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgttccgctggtgtaccagttgtgccgccaggcgcatcgctgggtagctatgaacggcagggataaacgctgaaagcatctaagtgtgaagcccccctcgagatgagatttcccattcctatatggaagtaagacccctgagagatgatcaggtagataggctggaagtggaagtgcagcgatgcatggagcggaccagtactaatcggtcgaggacttaaccaagtaagcgtgcaagcaggagcaggtttctgcgactgcgaacacatttcgatgacaagtacgttaagttcaaggcagcaattaaacgatgatagccagttttgagagcgcaaagttctcataagtgtggtggcgatagcaagaaggatacacctgttcccatgccgaacacagaagttaagcttcttcacgccgagagtagttggtgggaaactgcctgcgagggtaggaagctgccacgctaagttaggatctggtcattgaccggatctttttttataccttgataagtaagtggcagtcgtgctaaattgcaagagcaagcatggaaggggaacacatcatggcaattgaggcaacgaaagataacttgaaggcattgacagctgaaggcacggttgtcgtcgatttttgggcaccgtggtgcggcccttgtaaagtgcttgatccgatgttaacggccctagagcaagaactgccagcgcttaaagtggttcgttataatgttgaaaaagatcatacgttgccgagcactatgggcattatgtcagtacccaccttagtcatttatcagcaaggagaggcgcgcgaaaaagtgacaggtgtttaccctaaagacaaacttaaacggtattttgaacagaaacttgaggcgtaggtatgacacattcagttgagcgtcaggatacagcaatccaaaatcaagtattggcaacatgcttgcttgctggacgcattatgattgaaggcggttcggaaatgtatcgtgttgaagatacgatgcgacgaattgctgtgaatgccggtgagccacaaacgttggtgtttacgacgccaaccggtatatttgctagcatcgaaaatcagccgtatattcaggagcggccgattagcaaacgatcgattgatatggaaaaagtgacgcgcgtgaatcaactctctcgttcgtttgcggctgatcagattgatctagatgaattgcacgcggcattgatcaaactggatcagaacaccccttttttcccgatttggttgcaggtggtgagcgcggcagttgtcagcatgacactcatggtgttatttgctcaacagtatgactggcttgatatgcctttggcagctgcggtcggtgcattgggctttctagttgatatcaaagtgaatgcagtgaccaacattcggtttattagtgaattactgggcgcattggtcgttggcttaactgcgtggcttggggtcaggttaggcctaggacacaacctggactttattattattggagcgattatgccgcttgtaccgggggtagcgattaccaattcgattcgcgatatgctggcgggacatttgctgtccggtatggcccgcgggatggaagccattttgagcgcttgtgccatcggtgttggtattgctatgatcttccggttcttctaaaaacataaaggaggcggcatcttgcagtggtggtttgctttattagttcaacttttgttcagttatttggcaacggtcgcttttgctatcattatcaacgtgccgcgcaaggcgttaaatttggctggttgggccgggatgatgggctggttggcctactggttgttgatggaagtcggtagtggccggatgatggccaatttagtcggagcttttgtcattggcttgtgtggaatcttttttgcgcgctataagaaaatgccggtcatcatcttcaacatcccgggatttgtacccttggtgccaggcgctgttgcttaccaagcagtacgagcaactgtcttaggcgacctggacggggccttgcagtatgtcagtcgggtggtcatgatcgctggtgccattgctgtcggctttatgttggcccagctgttatcagaagtgttgtataaacgagctgttttaaaaccgaaaaagtgatataatcatgttatgcgatgagtcgagtaagcacgcaacttgtgctgaaagctgcagctgactggttaaaagccacccgccggatttgtggggtcagcgatctcaaggttgtggagccagcgagatcctatccaagtcaacttgggtactgcagaaaaaggacgtttttgcctttaaggtaagaacgtccttttttatttgcaatttaactagactgactacaaagacaaactctttttgctctaataactttattagaatagagggttgacttagacatgcatttcctctaagaaagttattgacaggcgtttggttgtcatcaaaataaacattcagcaaattaccaataaaaatttctgagaaaataagttgactttccttggtaatcatattaagattttaaccaaccattaatcttaactaggagggcgtattgatgtcattgatgtgtatgcaaagaaaaacaaatcgtaactgtcattacgctcttttagccttgttgttgatgccagggacccgaccgaattgatcgtttaagatcaacgtgttgagccccgttttcgcattggcgatggggcgtacgattagcacccattcgtctgaatgggtgcttttttctgttaagaatcaatgagatatagtcataagcaatataatgagggggaaccaagatgaagaagcaaattgtcaaagcaattatgagcgctggcgtcatcgcagcttcgatgctggcattggcaggctgtgcgacaaagagtgccacgagcaaaggaaatacggcaggtaacacgattaaaatcggcgtgaacatggagttgtctggcgcggttgctggttacggcgaacagcagaaacaaggtattgaattggccgtgaaacagattaacgctgcaggtggtattaaggtcggaaatactaagaaaaaaataacggcggtctatcgtgacaacaaatcgtcaacgagcggcgcggcttcagtagctgcacagctggcgaatactgacaaagtggttgcgatcgttggaccggcgacaaccaatgacggaacagcctctattccaaacgtgaccaaggcggccgtaccaatggtgagtcccagtgctacggatccaaactttacacttcagaaaaatggcagcgtgcaaccctacgttttccgtgcttgcttcaataacgattttcaaggagaccatgcggcgatatttgccaacgataccttgaaggccaaaaacgtggcgattattgctgacaactcgactgattacggaaccgggttggctaaggcattcaagaagaagtttaaaggtaatatcgtgacgactcagtattatcaatcaggtgataaagatttcaatgctatgctgacagcgatcaaaagcaagaaaattgatgccatctatgcgccgggctattattcagaattaggcctcgtcatcaagcaagcgcggcagtcaggcatcaaggtaccgtttattggtgcagatggcatggccgatcctaagttggcacaaatcgccggcgctgcgaatgcaactgatatttattacaccacgccattttcgacgctgagtgctaacagcagcaagctggtgaagaactttatgaccagctttaagaagcagtatcaaacagaagcaccaacgttctcagcacttgcctacgattcggtttacatgatcaagcaagcgattgaagatcagaaggctgccgattcagccagcattgccaagggtttggccaagatcaaaaaaatgcctgctgtgacaggcaccacgaccattgatagtcaccataatcctgagaagccactggcggttgagcaactgacacaaggcaaaattgccaaagtctataccgttaagtaaatgactgcggcagctttttatgaggagatcatattttgcaaaccttgatgcaacaaatcattaatggactctcacttggcagtatttacgctttactcgcgcttggttataccatggtttatgggatcatcaagctgattaactttgcccatggtgatatctatatgctcggcgcgttttggggctattatgcgattaattacctgcacttcagttttgttccagcattgttgtcggcgatggtgatggctgcactctcaggcgtcttgattgaatacttggcgtatcgtccgttgcggaattcaccgcgaattgcggcgttaatcactgccattggcgtttcctttttcctagaaaatggcatgtcgtttctattcggtgctaatgcccggaactttccacaggtcatcaccactaaaacctaccagatactaggggtcgatgtttcaaatgtgcaactgcttattttgttcacatccttggtactgatggtgatgctgcagttcattatcaagcaaacaacgatgggcaaggcgatgcgggcggtggcagttgatccagaagccgcgcaactggtggggatcaatcccgatcacgtcatttccttcaccttcgcattaggatcagcactggctggtgcagcgggtgtcatgatcggcttgtattacaattcgattgatccattaatgggaatggtgccgggaatcaaagcgtttgtcgccgcggttgttggtgggatcggatcggtcccaggagcggctgtagggggcttcttgattggcttgctagaaactggtgttcaggctgtgggcttatcggcctacaaagatgcggcggtttaccttgttttgatcatcatgctggtcgtgttacctgctggattattcggcaaacgtcaacgggagaaggtgtgagcctatgtttaaaaatatgcgcagtaagctcatttggctcgcgacgatgattgctggctttgtcttgatcgacattggtgaattaaccggcgtcattaacgggtttatcgaaaatgcgctggtcacaatcggcattaacattattttggcagtcggtttgaatcttattatcggattttccggtcagttttcgcttggtcatgctggcttcatggcgattggcgcttatgccacggcgatcatcacgcaaaacatctcaacgccgcttgggttttaccttgctatgctggtcggcatgatcgttgcgatcattgccgctttgattgtcggaatccccacgttgcggctgcgaggtgactatttagcgattgccacgatgggcgccgccgagattatccgagtcattattaataatttgaaaatcaccaatggccctgctggtatgtttaatattccgcctttggcttcgtggccaacggtctatatcttaatgtgtgtcactactgtgatcgttgtgaacttcattcacagtcgggcgggccgcgcggtgatggccattcgtgatgatgacattgccgctgagtcgattggcatcaatccgaccaaatggaaactggcagctttcgtgctcggcgctgccacggcagccattggcggttcacttcatgcgagttacttgcaaacgattgctcccggagattttggcatcatgaattcgattgctttgctgattatcgtcgttttaggcggggtcggtagtatcactggcacttttgtcgcggcggttgtgttgggcatcatcgatacagtgctgcagaactttggcactttgcgaatggttatctatgcgctggcactcattttgctaatggttttcaaaccagctggcttattaggccattatgagttgtcgttcaagcgcaagcgccagattcggaaaggagcagcatcatgacgcaacaattggtaattgatcacgtcagtaaagtttttggcggtttaaaagccgtcgcggatgtcacgatgacgatcgaacaagggacactgattgccttgatcgggccaaatggcgctgggaaaacaacattgttcaatatgttgactggcgaatctgggccgtcgtctggcacgattaccttgtatacggctgatggaccagttgatattacgaaaaagaaagcctatcaggtggcgaagctcggtgttgctcgaacttttcaaaatattcgcttgtttggcgccatgacggtcaaagaaaatgttttagtggccaggacacatctttatcgtgaaagtttcattggcacgatgctgcggttgccgcagttttatcaacaggaggcagccgtagcaactgcagccgacgaattgttagatttttttgagcttgctgatgtggccgatgaaccgactgctagtttgccatatggtacgcaacggcgggtggagatagtgcgggcagtggccacaaagccgcaactgctgtttctggatgaaccagctgccgggatgaatccagaagaaacggcagatctggggcgtttgattactcggattcgtgagcattttggcatcacagtggttttgattgaacatgacatgtcgctggtgatgaaattggctgagtcaatttatgtactcgaccatggcgccatgattgcttctggaacccctaatgagattcaaactaacgcgcaggtcattagtgcttatctgggaggtgaaaaccatgcttgaggttaaacatctcgttgtgaactatggtggcattcaagctgtcaaagacgtcagctttagcgttcaaacaggtgagattgtcgccttgattggcgcaaatggtgctggtaaaagtacgattttgaaaacaatctccggtttgttgcgaccacgttccggtatcattgactatgaagggcagaaaatcaatggcatggcggcagccaaaattgtgaagcaaggcatctcgcaagtgccggaaggtcgacatatttttgctggtttgacggtagccgaaaacctgcaaatgggtgcgtttggactgaaggataagcaagctgctggcgaacaaataacgatggtctatgatcgttttccggtgttgaaggagcggcaacatcaagatgccgcaacactttccggtggtgaacagcagatgttagccatggggcgagctttgatggcaaagcccaaattgttgttactcgatgagccttcgatgggcttggcgccgattttcattcaagagatttttgacattatcacgaaaatcaacgcgcagggaacaacagtgttgctgattgagcaaaatgcacgccaagcgttggccatcgccgatcgcggttacgttttggccagcggcacggtcaagctgaccgggacaggcgaagagctgcttgccgatccggctgtgcaggcaacttatctggggatgcaagtgccttagataagccttagataagggaacagttaacaagcgtcaaaaagccaagccacaatatttagggcttggctttttgttgttattggtgacaaaagatcggtacaaagacaaataaacaggcactgacagatgcgtcagtgcctgtttattttttgtctgtatcagttaagtgaggttggacgacccttttgtcttacgatcgtttaaggattctgtccggtatcgcctggtgcttgtccgacgcctcgaccactaccgccttgccctggccgaatgccctgttggttcggtgtagcgaccatgtattgactgatcaagttcacaatctgtcgattttgcgggagtgagctgtgacccgcttcgtcgccggaaacggtgatctgggtgtagtgcgcgacctggttttggaaaatatatttaccagcttccacactttcgattgggacggtgccatcgccgtccagattttcggtaccagcaattgagtagacagtcaagctgctaggcaacttgttgcggctagtaatgagatcgttcagcatttgtgttcgattgtcaggattgctttcttcaaggttgtacggcgttccaatggtcatgagtcgtgtcatccgcacatcagaatcgctgtaatacttttcgagaaaaagggtgaagatcaagccgccattactgtgaccaataccacgaaaacgattgaaattataggttttcgccaattgcttaaaggcaatgttgaaccacgccgcctgtttcttgatgttgttataaccatctttattgttttcgaatgcgacaacgatgtacggctcggtatcacgtgctgcgattttgccactgtaagttagtgtaccattcgttttgaccgtaattttcagcaaactatggcccgttgtttgggcgtttagctgggtgatcaaggtgttgaaccgatcttctgttgctgaactcccaggaatcaaaataatcggttgcatacgggagttgtgaacaacgcgagcagatttaacgttttgttccatccagctggtagcggggagcatgatagccgttaccgccaagacactgaccagtaacaacagccattttcgccagtgtttaatcatgatgaccaccgacctttgctgattcaagattgattgtttctgctagccgcacaaatgggatatagataagaaccgagattgctaagcagaggatagccacgagaagcgatacccaattaccattggtgcctaggaaggctgccaacggtccgggcgttgtcgttggaatcgtataaactgacggcggcataagacgcaagcggatagctgcccatgcaatcgtcatattgactagcggtgcaatcaagaacggcacaagcaaaatagggtttaacatgactggccagccaatcatgatcggtgagctgatattgaccaagctcggcaaaagcgacatgccagctattcggcgtaatggccgggttttggcaacccaaagtgtcgcaatgatgagggctaaggtcatcccaacgccaccgaagctcgcgaagggatggtaaatggtgccaatggtgatcgggttgggcacattgaacaaattgttgtgctcaagcgcataattcagattggcagtgctggtcgtgctaccggcttgcactgttaacggattgatcggaccttcaataccagcccaccacatgagggcattaatggtggtgaccaaggccaatcgaatcgacacgtgactgaggctggaggcaggtatctgaaatggaatgtagaaaagcccgatgaaaccttctgtcgagatgcggctgaggctgtaattgatcgccacactgatcactagaatcacgacagtaagccaggtgccacgcagcccacggtcaaccaaggcagcgattgtataccgatgcgttggttcttcgaggtccgcacgtgtgaagcggaagagccaaccgataagcaagccgaaaaagatagcaataaacaaaccacgataaccaaaattattcatttggaaaggtgattggccattgcgtcgtgaatccaaattaagaatcataaatgccccgacactcgttaaggctgccaaagaatcatctttgccataagatcgggcaataaatttggcaacgaaaaacgccgccataaccgccatcagatcgagagtcactgtttggatcgacatcaaaatggtgcggatctggttatagtaaggaatgacggtgtcaagatgataaatgactgcaaaaaagccatttcgtgaaaacacactctgcgtcaacatttgagcccaagcaccgaccagaataaacgggaaaatgacggcaagggtttgttggagcgcgcgataaatgcgggtgtgtcgcaaccgaacgctattgttaacgagcacgggcagcaatctctgcatcagattgctcatggctgccatctcccttttcaatttttttaatggcgcattatcaatgctattctaacaaatattaatatcgccgagtagttttcgtattgaaaagaaagttaaaacaatgatgagacgccttatgaaaggtcgagttttacgatttctgctttcgataggcctccatcttggcgtggaaagtcgcttccgtcacgccataggccgcaaatgttaccgcattagcgccagcttcgatcgtggcagtgatctgctcatcggttttaccgccagaagcaataatcgggaaattcgggtgcttgctgtcaatggccgcacgaacttcggccacaagattggcggtttctttgccaccagcaatgttaaaggccgcgacaccggcatcaattcgggcgttaagatcatccatatgacggacaatggtatagatcgttggaacgtccaccacacgattgacattgatgagcgtttcaatcggagttggcgcatttaacacaacggcctgagcaccgctttcttctgcaaaagcgccaatggttgcggctcgcaagcccttggttagcccgccgccgatgccagccagaatcggcacgttagccaccgttgctaccgcttggagaatgcgcgtattaggtgtccacggatagacagccagaatcgcatcagcatcgcaattcgcgatcacagcgacgtccatggtatagatgatactgcgaatttttttaccaaaaagcgtaatgccactggccgctttaatcgctgaaggtgcttgaacaatatcagtgcgaagcttagaagttaaattcgggggcatgttcgtcatggaagtacctcactttcaagaaacaatttgattaactttattataatggatgagattaggtgaaggcgagaaggacacctttatgactgtttcgccataggtcgggtgtcccgaagccttcgagtttgctttaatcaactgccttgccaaaacgcatttgcaagccacaacttggcttaacggtacgcgtactcatgatctattcaaccctttctatgcacgattaaccataccatggtattcttaaggcaatctgatgaatgcgtcatttggtaaccgcattcatcttctgcagataagataagctttttggctgcgatcagaaggctatttatgacggaggcgtaaaaatggcaaaaccattggcaaagtacatcgatcatactttattgaaaccggatgcaacacaggatcagattgatgaagtattggcacaagcaaaacagtacggttttgcatcagtttgtattaatccttattgggttgttcgggcggcggctagtttgcgcgacacggatgtgaacgtctgcacggttatcggctttcctctcggggcaaacaccacccagacgaaggttttcgagactggacaggcaattgacgaaggtgctcaggaaatcgatatggtcctgaatattggcgaattgaaggcagggcataacgatcatgttcgtgctgacattcaggcagttgctgatatgactcatgctaaaggtggtttgctaaaagtgatcatcgaagcggttttgctcacggatgatgaaaaagtcacggcttgcaagttagcagctgcggcgggcgctgattatgtgaaaacatctactggatttgcagcaggcggcgcgacggtgcacgatgtcgctttgatgcgcaaaacagttggcgataaactaggggttaaggcagcgggcggcattcacacttatgctgaagctaaggcattgattgatgctggcgctgatcgtcttggtgccagtgcagggattcaaattttgaaggaagcaggcgaagcataagatggcatttgatcgcattatcacgattgtgttggattcaatcggtattggtgaagcacctgacgccgctaagtatgatgacaccggcgctgacacacttggtcatattggtgcctattttgatggtaaactggctttgccaaatttgcaggccattgggttgggtaatattgctcgaccaacaccaattgctggcgtgacggcgttaggtagtcccagtggctattttggcaaaatggccgaaatttctgcaggtaaagatagtatggatggtcattgggaaatgatgggtttgcctgtgacggaacctttaggctattttcccaaaggttttccggctgagttgattaaacaaattgaggagttttccggccgtaaagttgttttgaacaaaccttattctggcacagaagcgatcaaggactatggtgagcaacagctgaaaactggcgatctgatcgtgtatacctcaggtgattcggtgcttcaaattgcggcgcaaacggatgtcattccacttgaagaactttatcgcatttgccgttacgttcgcagcatcacaattgacgcaccatatcgcattggtcgggtgattgcacggccatatgtcgggacagatcccactacgttcacgcggaccagtgaccgtcatgattacacacttaagccggataagccgacagatcttgatcgccttcaaggtgctggcattgcgacttatggcattgggaaaattaacgatattttctctggccaagggctagatgacggtgttcataccactagtaatgttgatggcatggaaaaaacaattgaagcagtcaaatcggaccgccgcggatttattttcaccaatttagtggattttgatgcgatgtatggccatcgccgtaacgcgcaaggcgacggggatgctttgatgactttcgatcgacaattgggcgacttaatgacagtgctacggcatcaggatctattgatgatcacggcggaccacggaaatgacccaactttccgcggaacagaccacacccgcgagtatgttccgttgctagcctacagcaagcaattgccgggtaatggcgatttaggtattcgttcgccattttcggatcttggtgccacgattttagataattttggtgtcacaggtaatcaagttggccagtcgttcttaaagctacttaaataaacccacattttgaaggagaatcattgtcatgagcacacatattgatgccccaaaaggagccattgccgacgtcgtcttattgccaggtgatccattgcgagcacagtacatcgcggaaaactttctggacaatgcccaacgttacaacatggtgcggaatgcatttggattcaccggcacgtttgaaggccggcgcgtgtcggttcaagcgaccgggatgggcattccttcgatctcaatttatgttaatgaattgattcaagactatggggttaaaacgctcattcgcgttggcacagctggcggcatgggcgaaaatgtcaaagttcgcgatgttgtgctggcccaaggatcttcgactgatagcagcattatcttgaatacgtttggcgccgggctttattttgccccactagccgacttcaaccttcttcgtgaggcggcaaacttggcagatactagcgcaattcgctatcatgttggtaacgtgcttggcgaggatcgcttttataacgatgagatggatcgtcaaaaactcattgattatgaagtgctggcgactgagatggaaacgccggcactttatctacttgcggctaagtaccatgtgcacgcgttatcgatcctcacggtttcaaatcacttggttacaggtgaagaaacctcagcccaagagcgacagaccagctttaatgacatgatcggtctggcactcggtgttgccaaaacagttcctgatcgttagataacgcatgaaatctagttataccaaggctttggcgccgtgaattttacagttgaaatatttttttaatgtgcgtaccagtaggaaacgtgttattctgtatatggtttcttaagaaatggtaaacgcaagtaaaacgcaatttttgaaaaaattcagttttggattggaggagtacatacatggtagatgcaaagaaagtattgtcagttacggcaggattcgttggtgctgccggtttggcaactttagctaccggcgctaatactgtttccgcttcaacggggacagtcaattacaaatcgggtgcgaccaccgtatggaatagtccatcatggcatcaagtaaaacgctatgtgacttttggtgacaaagtacaagttctaggtcaaaaagttgaccgaaacggtgctacttggtataaagtcggcgacaatcagtggatccctggcatttatttgaattttgacggcaagactgtcaccgttcaagcaccagaacaaactgccagtcaggcaccggttagccaagcgccagctagccaagcacctgcaagtcaggcacctgcgagtcaagcagccgcacagcctgatacccagacagcaaacattcagttatatgttaaaaacattggttctgcagtcacagtttgggcaacaccagcgtacagtcaggcaactggccagtatctggaaggcaaccagacgttgacggcggttgcccagttgcaagccaatggcgaaacatggtatcggttagcaaatggcggttacgtgccagaacgttttgctagcacaacacctgcaccagcaccgcagtcatctgctgcaacgagtgttgcggcaccgactgcgcctgtatctgatgcaacggcttcgaacgcagctgcttcaaatgccgccgcttcggatgctgctgtctccagtgctgcagcgtctagtgccgcggcttcattagctgccgcttcagaagctgctgcggttgcgaatgcttctagcgctgctgcatcttctgctgccgctgtagcgagtgctgccgcagaatccagtgctgctgcagagtccagtgctgccgcatcgaaggctgctgctgattctagcgctgcagctgtgcagactacgacgcctgagtccagtgctgcgcctgcaacgacacaggttgatgcaactcaggaacagcaacagcaggcagaaccaagcaatacggtcaataccgaggaaacgacaaataacgcgacgccgactcctgcaccaacgccgactcctgcaccaaccccagccccagctcctgttacgccgtcacgtcaggcaaaaattcaggcggttatctcaattgctgaacagcaaattgggaaaccttatgtatggggtggcaagggtcctaacagctttgactgctcaggcttgatgtattatgcctttttaaacggcgccggtgttaacatcggtggttggacagtgccacaagaatcttctggtcagcaagtctcactgagtgcacttcagcctggtgatttgctcttctggggcggacatggtagctcttaccacgtagcgctctacattggtggcggtacaatgattcaggcaccacaaccaggtgaaaatgtgaagtatacggcattagcttacttcatgcctgattttgctgttcgtccttcactataaggataactaatggctaaaattaaactggaacattctcgcgagagggtgttcctttttttgctttttttcattccggggcaaaaaatatcctgcattcacgggatatccagtacgattcaacgattgatagctatcctaatcatcatagtccggacttttgatcagttcagatggagcagtctttgtaggggatttaaagatgtattttgcaatggatggcgaaatgttcttggctaaggcctgtccccaattttgtgagatctccagtaacgcaacatcatgtggttgagtcgagatcaatgacagaaaatgtccggtccactagcgattttgtccaagctgttggtatgtaaagctataaattgttgccgagctttttcggcacttccttagattgatctgctgtttgaatatttggtccctagatagacttgcaggcttggtagctatcctatagacaatatacgatgggcggccgcttttttgttgctttaaattttaacgttgataattgctgctttttcgtcgctagcagtgtcaaaaatgccaaataacgacgaaaaaagcggattttgctacgtttatttttaaacggtattgaacgacatctctctaagcaagtgagatacctttagatgcgtcagcttttttggagtgggggataactgaggacaatagaaagctgaaaagcacaaacagtgcactcaataagtgtgcactgcgttttggtctggtgagcatcatgcaagcttttgtagctttagctcaatgattacttaacccattttgcgattgactgacccacttggtacccagcatcaaagataccggtgaagatacctttcatgatgacttcgactgacaaatcgccgccaacaaccgacacttgttctgtgtaggtaagttcaggaaattgattcaaagctttttgattcattgtggcttcctccatttatcgtgtctatttcaaacaactagctatagagctacctttttgataacccacatgaaattaagtttgcaagactcccgtgccaaactgccaaagcatcaagatcaaaagacgggcaataatggccaaagggagcttctttgcgagaacgcgaagtacgaattgctttggcacgttcaccacttatttatacagttgcaggtttcttttcttgcgtcatgccatccgtaaagccagagaagacaccggacagaaatacagtgaggcttccaatgatgacgccggtagcgacaacaccaatgccgccttgactttctgctaattctgaatcatcgatgcacgaaaagtttttaagcactaagttattttccaacataagtttcagctcctagtattttttgaatgtttcggcttactacaaccacggcgattgtccataatgcccagcagtgcggaaaccattgctgaggtagcatcggcaattgccatgtagtgtcaccccttcgtttgggatagtacaagaacacatatgaaaaagtgtgcttagtatgtcacggttgaaggggtcaaaaatgatttctctttcctctccttcccgctaattgccgtagatctgagacaaaactatctaggtgctagcgaccctgtacataatatacaagtattaggcgatttataggcagcagagaaattaacgttgcgttattcgggcttttcgtggcttatttagccataagtttcaaaatgcgacgaaaaaagacgattttgcaacgtttattttttgctgttgattaatatgtttgaaaatagacattaacggtaggattaaaaattactcaagattaaaaacaactttagccacattcaatgattaaaatcgaaaaaaatcaccagtttctgaatcgtgatcgcggctcagatagtacttgttggccggcagtttcaaggctattttgtttggctgcttcaagctcaattttcgtgggcaaatagtttcatgcgcttgatcagacgcgaaagtgactgggtaatccgtgcattggaaaagtcagggaaaaattttcagacgtcaagcaaaaacgaatgacctcctctccttatacaggggaaatcattcgctttttggtttttatcgggtaatgactgggatttatgagtggggcagggcaaagaacttttttgcccttgcgctttttcccgggttattcggaacctaacaaatcataaattccaagaagaaatagtggctcttagatgattgtttgcaattcgaatggattaagctaccggtgttttttccatttcctgagctttggcaacggctgccatggcgacggcgttgacccagttgattggctggtcaaagtttggctggaagagcatgtcgaccatggccaatgtttcgatcgtcatgtgtgtttgaatcgctaaggagatgacattggcactttggctgatgtcatgcttggaaaagaaggccccgcctttgacttcgtgcgttttaggatcccaagtcaagctgcaaagaaccggcgtggtggtcagcataaaatcaggtcggtaatcctgctcaatggtcacgctggcaacctcaatgccacgggctttggctccttcagtggtcatgccagaggcagcaatggcgtgttcgaaaagttcaaccgctgaacttgattgggtaccgagatacttttcggttggtttttcaatatttttgccgactaaaataccttgacggacggcattggttgctaacggaatgtagtcatttttgccagtcgggttgtaatgcacggtagcagtgtcgccggctgcaaaaatagcaggatcgctagtttgcatataggcgtcggtgatcacggcaccatttggcaaggtctccaaatggtctttcagcagttccgtgtttggtcggaaaccggtacacaaaacagcgacatctgctgtatagctgcctttgtcagttgtgacggtcatctcaccatcagtgccttgggtgaaaccggtgaccatctcacccagtgctaaattgacgccatgatccgtataaagtttttctactcgatctgtaatggtagcgtcaaagtttttcgccaacactcgtggtaagccatcaatcaaggtaacttgtttgtcagttagtgcatactgttcggcaagctcggcgccaatatagccggcaccgattacgatcgcacttttaatggtcggagcaagcgcctttaaagccttggcatcatgccaatttttgcaaagatgaacatccgtgtcgtgaatgcccggaatgtttgggacgatcggcgtcgaaccagttgtgtaaaccaatttgtcatatgtatcagtggtcacgttgccggttttgagatccttgacttcaaccgttttcgctacaggatcaatcgccaaaacgtcatgctccatttgcatgttagcacccagcgcagccaatgcttcaggactggaataaaacattttatcaggatcactgacatgatcaccaacccacaaagcgatgccacatgatagaaatgatagattgctatttcgttcatagacagtcacgtcgtaatcgggatgctctgtcaaaatttgctgtgttgcgaatgtaccggcatgagtcgcaccaataacaagaactttcattaggtaaacactccttcatatattgataaggttttcacaaaaagtgtaacataattagttgttcgtgactagattgcccacgtttaaaattgtgaaatatttattaagaaacgctttcaacaatataaaaaatatttcaacaaaaaatcgattaccaattgataggcaatcgatttttcgttaatgtcgcggcgcgggttgcaaccagcgcccgatgagttcgagatgatgcatgagctgatatttacgaacaatgccaaggccgggaaaatgatggcgggtggccgcggtcatgaacgcactggttccagttgtttgcgcatctgggtgaaatggcagccatgccgttagttgatccaagacttcgaaaaacttggcttgcggattggcaaagtcgtcgttattaaccgaaacgaagtgatgcaaccgcaatgtgccatcggccgctggataaaccagatgaatggcgacagctcgttgcggataaccatgctcgaaatagtcactggtggcaaggggatagtccgcaaagccgataccaggcagtgaagtcggagcgtactgataaaactcatcttgcaagataccatagtcatccgtgtgtggataaacggtgaaatggtcatttaaataaatggcgtgaggcaaagccagtcggcgaacccgcgcctcatcaggcaccaaggctagctggtgccgtggcagaacttttgcttgcgctgctgtcgttgcgatcaccagtgcggctggtcgggcatcaaaaattcgggcgggctgcacaacgtcacttaaaacaacaacatggcgcggcgctgccagtaactgatacgtgccgacttgcggattttgaattacatagcccggatgtgctgcttgaaccagagcgctagttaccttcgtgacgccggggatatctttgaccggttcaatgacagggatgacggtttttggtaattggtgatcggcaaccagctgtgtcaccgcagccagatcatataatttaccccggataatcggaaaatacttcatctgttggcgtccattttgatagtggctagttcagcattcaacgcgtcaatctcttcttgtaaggcattgatcgtggtattgtcgagctccgaaacaaactgatcataaagattcttgtcagggtgataaatatcgtaatcggttgagcgttttttcagttcagtaaatagatcggcttctgagaattggccaaggcccttggcaacttgtttggccttgactacttcgcgattgaggctggcgatgaaatggtcggtcaaagtggcttcagggacttgcagttcttgacggcgagctggtttggcgatcgtcaaagtaccaggtgttaccacaggaacagcgctggcggcgattgcggctttagagaagggatggtaggtaaaaacaccgatcccatgtggaatttcactagccaccgccgtgtacagtcgttgtggcaagacaaaatagttgtaatgaccgataaagctgagtttggcgctactatggaaatcggctttggtgactttgagctcaaaacaacgccaaatagtcgcgtcttgctgtttttggcgaaccagcgtatcgacaattccgcgatcgtctggcatcgtcacttcttcaaccacggtggccccttgttcttgccagtaggcataaagcgttttttctaaatcaagcgtgagctgtgttttcatgatgggcctcccagaaatgcgtcaagagttgagctaattgcgttgggttgtagctgacttgggcgtgggtccagtgatctggaaaaaggcgggcataacgtggggtaataaaccgttcgtcaatcagcagaatgactccgacgtccttggtaccgcggatgacgcggccacctgcttgtaacacgttattgaaacccggcagctgataggcatatgcgaatccttgaccgtttgcccgatcaaaataggcccgcagttgatcggtttcagcattgatacctggcaaccccacggagataattgcaacgccaatcagtcgacttcccttgagatcaatgccttcagcaaagatcccgccaagcacggcaaacccgataatcggctcactgccagtttgaaaataatctagaaatgtttgccgatccgcttcagtcatggcattttcttgggcgcaaatccttagatcgggattcgccgcagtgaaggcttcataggccgttttcaagtaggcataggatggaaaaaagaagagatagttgccgcttttggtgcgaactaatgttgtcaggctcgcaatcaactgcggcaaatcctgcgtgcgtcgtcgataagtcgtattgacactagcgtcaacaataactgcttgtttggcgggatcaaatggggagggcagcgtataggcgagactgttgtcgatcccgccaagcaacttttgaaaatatgccatcggtgataaggtcgccgaaaataagacggcaccacgcccttttttcaaggcttcgtccacaaattgcgatggatcgagacacagttctttaaccataatctggccgttttctttagtgacttcggttttgaatgtcgcgtcatagaagtcgccaattcgcagatattgattggctagaaaaaataccggcaaaacgagatcgacagcaggttgcaacgcgggggttggcggttcgctgagccaatcgtgaacgacttcggtgaagcgaaaaagaactgcggtgaggtcatcaagcggatcatcttgaaagatggtcggttgtgaggtcaacaaggttgaagtcgttgcatcaagggtattcaaaatacgtgtcatggcgcggcgaacttttgtcaaaggggcacctttataaggggttagcgctttttttaactggacgaaatcttgatctgtgatggcagcggtgtacatgtcccgcgcgcgactgactaagttgtgcgcttcatcgatcaggaagaaattgctatcatctttttcgctaaaaaagcgttgcaaaaaaaccagcggatcaaagagataattgtaatcacagatgatgacgtcgcaaaataggctggcatccagtgaaaattcaaatggatcgagcctatgtttgcgagcataagtctcgatgacgggacgcgtcagttgatcctcgtgttccagtagatcgtgtaaggctggttttaggcgatcatagtaacctaacatgtaaggattcttgctggggtcatcaggttcgtcagcaaatgtgatggtgtctttagccgttaaagtgatacttttggcggttaaacctgcttgcgccatcaaggccatcgcctgttcagccacgcgtcgagtgctttgcttggcagttaggtaaaaggctcgttggatcaagcccgtgcccatcgcttttaaggttgggaaaagtgcagagatggttttaccagtgccggtgggagcttgcacaaacaaacgtgcttggctatagatcgccttataaacagcggcggctagctcatgttgaccagctcggaattgcggaaatggaaaatcaagctggtcgatggaggtgttgcgtcgtttgatgatatcactacgtagtttgagccagtcgcgaaattcttcaagtaaatcagtgaaatcatcagccaactcggcggcacttttgacttcactgaaacggctgactgtgtcggtgctggtctggacataaaccagcgtgattgttgcttgatccaaatgccgttgttcacaaagtagatggccataaatacgtgcttgcgcccaatagcggtcttttgtattttgtgtggcctcttcccatgggcgcgcactggttttgatttcctcaactgtgaggccggtgtcatctgtccagacaccatccgctcggccttcgagctgatagtcttcatcgttcacggtgacggcggttttgaggtaaacttccttttcgtaatcggactcacggtgagcagcttgaagtttacgatgaatttggctaccaatgatggcggtgttatttgaattgctggtgattggattgaggtcgccggtgcgaacggttaactcaacgaactcacgaataccaatgcgattgtttgccatcactgcgcccccttgcttgtcatggttagttattagtatagaacatacattctctatggggaagactggtgagtcagggtcatgcgccgtcacgctctagctccgcgtcgcaagcctcatcaggccggagattgcggagtttggcacggcaattttagcgtaacttttgaaaactaaaaataccgggtgtttctttgcttttataaatataagaggcataataagggtgtcaagacatgacaaatacggcggcttgcaaacactgtcgatcggtaagccgcgacactgaatgagggacatagaaatgaaaaagactagtttttggcggctattaggcttaatgggtgctgttttgttgttactgacagcctgtggcaagcaggggacggctacgaaatcgtcttcaagtgcgccagtgaaaatcacctactggcatcggatgacggggacttatgataaatcgttgaacaagctcatcaccaagttcaaccagagtcaaaagaagtataaagttgtcgcaacttcgcagggatcatacaacgcgttgcaacagaaaattatggcagccggcaaatcaaaaacgttgccgaccatggcgcagtcaccgtatacgaacattggcgactacgtgaagaacaagttgttattgccatttgatccagaaatgttaaatggcgcggataagttgagcaatgctgatttaaaagatatttatccaagctttttgtctgcaggtaaatatgagggcaagtactacggattgccattctcagtctcgacttcggtgttgttttataacaagaagttgatgtcccagtacaatatcagcataccgaaaacatgggctgattttgcagccgatcaggagaaactcaagggaactgatgtcaacgcgattgagttagatcaaagttatgatgttgcgcttgaggggatggcatatggtgctggcagtcaactaattacaccgaaactgaaggctaatttgaatgcaccgaagacattggcagctgtgaatcaaattctggatctgcgcaagagcggtgcgttgaaaactgctggcgaagatcaatacttcagtgtgccatttgcaaatggaaaagcggtctttgggattggttcttcggcaaccgtgccggttcttatccaacaggccccaaaggatcttgactggggtactgctgtgattccgacatacgaaggcaaacgcagcaatccactgaacggaaattacaatgttttgtttaaaggggcctctaaagcgcaacaagcaggtgcttgggcgttccagaaattcttgctgaagtctgaaaatgcatcacagtgggcgatggattctggctatgtgccggtgacaaaaacggcatctaacagcccgacatttaagaattatctacaaaagaacgacaagtataaagccgcggtctctgcagtttcacagagttttgcctcaactgtctttaccggttacaccgattatcgtaacgatttgatgagcactgtcgacagcacgctgaccaagaatgtcagcggcgaaacagcgtttaacaatttgcaaaagcagactgaaactattttaaaagaaaataaataactttatttaaaaaaagactagaaggcgagcgttgcttgccttgatggtcttttttagtttgcgtctgcttgctgtggtgggctatgatggtctgagcagttctaagcttttaaggagactgatatggaaatcaatgtacacaagtttcaggaagccattttagatggcagcttcgagcataccgagaatcatctgaccgctgcagcgttcaaaaaggacggcatcgaggcgggcttgacgaaggtgtttgcagacgtccgcaaggccatcgacaagcagcaactgattcaggccgacctcgtcatcgattttcctgagccgaccatcatcacagttgaaactggcatcatcaatctgccgtttgcgaatgtcaataaagtcacgaactttcttgaggcagacgagattgtgccggttcgggtctatttagtggtggcatcaccatttgtgaacgtgtcgggtttgagaatcgatgaaattgcaacggcagcggattatctcacaggctttgagacgctcaataagcaaatgaccgcttccgttcatgagaaacttgaccatattcaagaagaaatggcgaagcccaaagaaaccgcaaaaccggtgccagctaataagcaaaaaacaccagccaaaaagaccacgcgccggacggcaatgaagcgaacaacgacgcgcaaaacaaccaagaaaacaacgacagcggcgaaaacatcagcggccaagccagcggcagctaagaagccagcggccaagataacgaagcggacgaccaaaaaagcggcgcccaaaaccactcggcgaacaactaagaaataagctgctagtcgcatgctgaaaagagtcattccatttgggatggctctttttacataccaacaagaccatctagaccctttaaagcgaggggataaccatttgaaagcaaacatacaataatattaacgaaatatgagaataacgtgtgagatatgaaaatcattttgaattgaaagcgattccagcatattcttaacttgttggtggaataggccaatcttgttgcagaaaccatccacaaaaggaggttgaagttttgaagaagcacgggtttcgattttggttattggcgattgttggactgctgggtatggtgttgagtctgagtcagccgcccaagcaggtagctgctgctgataacgccttgaaaagcgttttttcgattgatgcgggacgaaagtatttttccgcggatcagttgaaaacgatcattgatcgggcacatacagacggttacaccgatgtgcaggttttattgggcaacgatgcattgcgattgctacttgatgacatgagcgtgacgatcaatggcaaaacatatggcagtgatgtcgtgaaacaggccatacaggctggtaacaaagcgtactacgatgatccaaacgggaatgcgttgacgcaaaccgacatggatgcggtcttgaaatatgcagcggcacgggatatcaatatcattccggttatcaatagtcccggccatatggatgccattttgacggcgatggcgcaactaggcattaagaatcctgcctttaatgggtctaaacggactgtcgatcttaacaatgacactgccattgccttcacaaaagcactattgcagaagtatgtgatgtatttcaagggtcatgctacgaccttcaactttggcagtgacgagtatgcaaatgatgtcgatactggtggctgggccaagttgcaacaaagtggcacctacaaaaagtttgtggcatacgtcaacgacttagcggcgatggccaaaaatgccggcctgaagccgatggttttcaatgacgggatttattatgacaataacaccagtttcgggacttttgacaaggatttgatcgtctcttattggacggctggctggagcgggtatgatgtcgcaaagccagagtttttgaccgataagggtttgaaaatcatgaatactaatgacggttggtattgggttttaggtcgcgtggacggcgatctctatagttacaaaacggcgctagctagtttagcaagtaaaaaattcactgatgtaccaggcgcttcgagtgctgtgccgattattggcagtgtgcaggcggtttgggcggatgatccgagtgcacagttagacatgccggcgctgttgaagttgatggatcaattttcgacagcctatgcaccttacttagttcgcccagccgattacagtaaagttgatgccgccatcgctgccgtgccgcggcaacttaatcagtacaccgatgcatcagttgctaaacttgatgcagcgttaaatgctgttgtccgcggtaaaaaggcaaccgatcaggcattggttgacggctatgcccagaccattacggtcgccatcaaggcactgcaactgcggccagccgattacacaaaggttgatgccgccattgcagctgcaaagaaacttgaccggtcacactatcaagaccttagtgccgttgatgcggcgcttgctgctgttaatcgtaatctcagcatcacccagcaagcccaagttgataccatggctgccaagattacagctgccatcgctgcgttggttctgaagccggcgccgcaacccgatccaaggcagcagcaagtgccaacaaaaaccattgtgaatccagaccggtatttaccaaaaacggcagaagcttccgggtgggaattgatgctagccgggcttgccacgattttgggtgtcattagcattgttttcttttggaggcaacatcgcatggccgtctaattcctgacaataaccgaaaatacggcccgctacgcatcttttgcgcaacgggccgttatggtgttgtgcgccaacaccatttcatagtgtcacgcaaggatttgatgaaattgtgatgtcattgagatgattttggctgttttgacaactacctcgccagcatttacccgcaaaataatcggctagtaaggttccgtcttgttatttagtttaattgagccgcaagtttacaaaataaaggtcagcggtctagataggtactgtataatgaacttgaaaacgacgaaaaagcagcgcaaaggcaaattggttagaaaacggcgtattagcggacatgaatgagatgatggggtgttcatcatgtggttcagaggtttaacatgcggatttctgatctgaagcgcttgtttagaaaaggagtgggcattttgacagaaccattatttttaaaaccatacttcaatcctaagatatggggcggccgcaaactcgaaactgagtacggctttgacattccagacggtaaaatcggtgaggcttggatcatctcaggtcatccgcatggtccggcgaccattgaaaacggtccattgaagggtaaaacccttcgcgaggcgtggcatgaagatcccgcttattttggtccacaacatagtcaggagttcccgttgctcgtgaagattctcgatgccgaagctagtttaagtgttcaggttcaccctgacgatgcttatgctgcggcccacgaagcaaaaggcgaactcggtaagactgaatgctggtacatcctgaaggcagatccaggggcttatttgatctatgggcatcacgccaaaacgcatgaacagctcaaagaaatgatcgaagccggcgattgggagcacttgttgcggaaatatccagtcaagactggcgactttgtgtatgttccaagcggcacgatacatgctttaaacaaaggcatcgtggcattggaaacccaacaaagttccgatacgacttatcggctttacgactatgatcggaaagatgatcaaggtcacaagcgtgagttgcatattaagcaaagccttgatgtgacgaccgttcctttccatgacccgaagcttgatatcaccaaagaacaagtgacaggcgggcaaatcaccacgtttgttaaaccgccgctgtcaccgcattttgccgtttatcgccttgatgttgatggcaccatgacgttcacccaacaagcaccttataccaatgtaacagtgcttgacggtgacgggaccttttctgcagacgggaaggattacccgatcaaaacaggcgatagtttcttgattcccaaccagatcaagacttgggcattcactggcaaattggcaatcgtcacttctactccaggggtagacgcataaggttgcggatcatcaggtgcccaacatattcataaagacaaaagttatccctcgacaggtttttagaccatcgagggatttttttgttactggtgtgattaaatggctgttaaacaaaaaattagaacgtaatgagaacgctttcttatcgaaataattattttcctgatttggtctaattatggaaatgtctgttaccgcttaattcatgatttcaatttctttttttaacgaaaattggtacatgttgtcattttgagaacctgtaagtcgttaaaaataaaaataagtcgcatgtattgacttcacgaactgggaacgcatacactacaagtggttggtaccacgtggaggtgagatgatggaaaaggttccgttgacgaaacagctggtagatcagctggaaacgttcattaaggagaaacttcagcccaacgataagctgccgtccgagcgggatctcagcgagttgtatcaggtcagtcgcaacacagttcgtgctgccttgaacgaattgttcttgcgcggtttcatttatcgaagcactggtaaaggtacatttgttgcagaacgatttgatgagcgaaccgatgtcagtgggtcctacagtttcactaaacagatgttggcaatgaaccgtaaaccagtgactaggatccagcgtttagaaaaaattgcggcacccgccaaaattgccaagcgcatgcgcatcgaaccaggcacgcccgtttacgtccttgatcgattacgaatcgctgacacgttaccgatgatgattgagcgcagttacttacctgctaacactgtgccaggtcttaatcaggaagcactatcaaaaacgccattatacgattggctggaaggtcattatggcattcacattgtttcagtcgatgaagcgttttttgctggattagtcacgccggaagatgctgaacaacttcgagttgcaccagcgtcagcctgtttgaacattcggcgaacaacttttgccgataccggcgagattgttgaatacaccttgagtgtggctcgcgcggatcaatttgtttatcacgtacatcacgttaatcactagataataaagcataagccagtccggcttaggggctggcaagcaggtttccaataggaggatgaagaacattgttcgaaaaaacaactgaagaactaaccaagttaggtgcacaaattacaactgctgaaatcaaacagcagccagaactatggcaagaagcatttgataactataccaacgctaaggaaaagatcacggcctttttggatcaggtgacggccgccgctaatggcaaaaccgttcgcgttattttcactggtgccggtagttcacaatatgttggtgacacggtgatgccatacctacgcgcgcatggtgatcgcagcaagttcgaatttgaatcaattgggtcaactgatattgtgtccgcaccttacgattttctggaagcagacacgccgaccattctggtttcctttgctcgtagcggcaactcaccggaaagtttgaaaactgttgaactggctgaacaagttgttcacaatctccatcaaatcagcattacctgcgcaccggaaggccaattggccaagaagtctgaaacggaagacaagactttgttgctgttacagccagctggttcaaatgataaaggctttgccatgacaggcagtttctcttgcatgaccttgagtgccttgctggtatttgataccgccagtgacacggataagagcaagtgggtgaaagccattgcggcaatgggacaagaagttgtggcgcgtgaagcggaagttcaaaaagtgcttgaccttgattttgatcgtatcgtctatcttggctctggcagtcttggcggcttgacccgcgaaactcgcctgaaggtgcttgaactaacagctggcaagtatgccaccatgtttgacacttccatgggcttccgtcatggtccaaagagtttcctagatgacaagactttgttgttcgacctcgttagcaacaatgcctacacccgtcaatatgatatcgatgtccttgaagaagttaagggtgacggtattgctaaatccgtgatggcagtgggcaccaagcaggatcagaacttctcaggcgatgccttctattttgaaaatggccctaaagatcttccagaagcttatcaggctctcccagatgtcatgttcgcccagactgtagcattgcttgcttcgatcaaagttggcaacttgcctgacacaccatcaccaaccggcaccgttaaccgagttgttaaaggcgtgaccttgcacgattacgctggtaaagaatagagcgtgaactggcaccaagcagcatcaacgagcaagtttagaggaggcaaaagagttcatgagttactacattcacgctgcaaagttttttctcaaaaatgtgactgaaattggtggttatctagaagtcaccgatgatggcaagtttggcgagtatctgccggaaacagctaagccagatggcgatattgttgaacaatccgggaaattgattgctccgggtttagtcgatacccatattcacgggttgttagggcatgacgtaatggacaacgattgggatggcattgagacaatgagcaaaaacttgctcaaagctggtgtcaccagttggctgccaaccacattgaccggttcatttgatcaactcaatgaggtttgcaaaacgattgccgcacatgctggcgatgaaagcggtgcgaagattcaaggcatttattttgaaggcccatactttacgaccaagcataaaggggcacagaatccgaagtacttcaaaaatccaagtgagcaagaatacgatgcttggcagacgtccgctgatggcttgttgaagaaaattgcgattgccccagaacgtgagggtgctgctgacttcactcggtatgccaccgcagacggcacggtggtggctttgggccatagtgatgccacctttgagcaggctaaagcttgtgtcgaagccggtgcaactgtcttcacacacactttcaatggtatgagcccgttgagccatcgcgaacctggtatggtcggagcagcgatgtatctgcaaggggttgatgatgagcttatctgtgatggtcatcatgtccgtcctgaagtggccaccaccttgattcgactgaaaggcgctgaacatatcgcattgattaccgattgcatgcgcgcggggatgatgcctgatggcgattacgtccttggcgaattcccagtttatgtcaaagacgggatggcgcggatgaaagatggcgacagtctggcgggttcagttcttgaattgaaagatgcgctgaccaatctccttgcttggaacgccgcaacaccagaagcaattattcgaatggcttctcaaacaccggctgcttcttgcaatatcgacgatcaatgcggcagtattttacctggccgagccgctgattatctagttttagacgctgatctcaagctcgaagccacctatcttgatgggaaattaggctatcaagctgaagcatgaaagctttcctgacacaaaaccttgtgaaataaggtgtcagtgtgtgacacttaaatatggcagcataagctgttatgaatgaaaggaggccagcgctgcatgacgaccttttcgatcgatcatgagtttatgttggacggtcagccgttcaagattctgtctggcgcgattcattacttccgagtccatcccagtgattggtatcacagcctttataacttgaaggcactgggatttaacacggtagaaacctatgtcccttggaatctgcacgagtacagcgaaggtgactttgatttcagcgggattctcgacattgaacgctttctaaacaccgcaaaggatcttggcttatacgccatcgttcgaccatccccttacatctgtgcagaatgggagttcggcgggtttccagcatggctgttaacgaaaaagatgcgcttgcgaaccgacgatcctgcctatctgcaagcgattgaccgttactacacagctttaatgcctcatcttgtgggtcatcaagtcacgcatggtggcaatgtcatcatgatgcaagtggaaaatgagtacggttcatatggcgaagacaaggattatcttgccgccgtggccgaacttatgaaaaagcatggcgttgatgtccccctttttacctcggatggtccgtggccagcaaccttgaacgctggcagcatggccgacgctggtattttgactaccggcaattttggctcacgtgccgacatgaatttcgatcggttggcggccttcaatcaagctcatggacatgattggccgttgatgtgtatggaattctgggacggctggttcaaccgctggggcgaaccgatcattcgccgcgacccagaagaaactgccgagaacttgcgagcggtgatccaacgcggcagtgtcaatctctacatgttccacgggggaactaattttggctttatgaacggtacctcagctcgcaaagatcatgatctgccgcaagtgacttcctacgattacgatgcaccattgaatgagcaaggcaatccaacgccaaagtactttgccattcagaaaatgatccacgaagtcttgccatcgcaggcccagacaacaccactggtcaagccagcgatgaggcaggcggacaatccgttgacggcgaaagtgtcattattctcagtacttgatcagctagctcagccagtagccgcaccttatccgcagacacaggagtttcttggccaatacaccggttatacgttgtatcggacaaacccgctgatcagtggtaccgacaaaggcacgccggctaagttgcgcgtgattgatgcccgtgatcgggttcaagccttctttgatggcaagtcgctagcaacacagtatcaagaggccatcggcgatgacatcctgctcccagaagttgaaggccgccatcaactagatctgttggtcgaaaacatgagccgcgtcaactatggctcaaaaatcgaagcgattacccagtttaagggaattcgcaccggtgtcatggtagacctccatttcattaaggactacctgcaatacccacttgacttgaacaaggcgccgcaacttgatttcaccggcgattggcaagcagggacacccgctttttatcaatatgggtttgatgtggtgaaaccacaagatacgtatcttgattgtcgtggatttggtaaaggagtgatgctggtcaatggtgttaacatcggcagattctgggagaaggggccaacgttgtcactatatgtgccagccgggttgcttcacaccgggcacaatgaggtcattgtttttgaaaccgaaggccaatatgccgaggcgataaacttggttgaccacccaatatttaaggaactaaacacagaggaggaataataatggctattattgcagcacgtattgatggtcgcttggtccatggccaagttgccaatctctggaccactaagctcggggcaacgcggattatcgttgtggacgaagctgcatcaaagagtgatatcgacaagagtgggttacggatggcaaccccagatggtgttcgcctgtccgttctcgatgttgccacagcagcaaaccacattttgaatcacaaatatgattcacaaaaggttttcatcgtggcgaagcggccggagacattcctcgcattggtgaatgcaggtgttccgatcaccgacttgaacgttggtaatatgtctcaaactgatgaaacccgttcaatcacgaagtccatcaacgtggtggacgctgacgttgacacatttaaagaacttgatgcaaaaggggttcatctcacagcgcaaatggttccaggcgacacagcagcggacttcatgtccctgctcaaaaaaggatagggggagtcaaacatgattgcatggtggcaaatagcacttttaacattatatgcaggctatcaaattcttgatgaactgcaaatttattcagccatgagttcaccagttttcgccggcttaatttccggcttggttatgggcgatatgaaagccggtctgttgatcggtgcatccacacagttgatggttcttggggtcggcacattcggtggtgcatctaaaattgatgccaactctggtaccattctcgcaacggcattctccgttagcgccggcatgaagccagaagcagcggttgctgcgattgcggttcctgttgcaagtatcatgattcaaactgatattcttgctcgattctcgaacactttctttgctcatcggattgacaagatggttgatcaaaataactacaaaggtatcgaacgttacttcctcgctggcgcgcttccgtgggcactgtcacggatgattccagttggcttggctttagcatttggcggcggcttcgttaccgaccttgcccatgttttgaataccagctggaaatggttaggcgatggcttggcaacagctggtgccgtcttgcctgctgtcgggtttgccattctgttgcattacctgccacttaagaaacacttcccatacctcattatgggctttgttttcaccgtgctgttcacgacactgtttggcagcgttcagaccttgggtaccgcagttgctggggtagctaaagggttcactgcttccttcaacggtttgtccatgcttgctatggcattgattgcgtttgcctttgctgcgatcagctatcaacaaacaacaaagctgcacgacatcgcagttggcaatggtaatacagatgcagcatcaggcacagccgcaaacaagactaatgaacagggggaaatcaccgatgatgaactctaataaacctacgtacaaattgaccgataaagatttccggcagattaaccggcgcagcctgttcggcttccagttgggttggaactacgaacggatgcaaggttcgggttatctttacaccattttgccgcaattgcgcaaaatctacggtgatggcacaccagagctcaagaaagtcatgaaaacccacacccagttcttcaacacgtcaaacttcttcaataccatcatcactgggattgatttggcggtcgaagaaaaagaagggattgctggcgaagaaactgttgccgggattaaaaccggtttgatggggtccttcgctgctatcggtgattccatctttgctgccttgattccagctattttcggggcgattgctgcacaaatggcaacgcaaggcaacccagttggggtcttcatctggatcgctgctcaaattgccgtcatggtatttcgttggaagcaattgcgaattgcttataacgaaggggtttcgttggtcacaacaatggcgcatcgactggctgctttgactgacgctgctaccttgatgggtgtcttcatggttggtgccttggtcgcaaccatgatcaatgttaagattggttttgcgccgaagatcggcagtgtaccattggatttccagaaatactttgacttgatcattccaaaactgcttccagccttgattgttggcgcggtttactggttgcttggtcggaagcatatgacctcaacccgggcgattttcatcgtattgatcgtttcggtgctgctgtcggcactcggtgtcattgctaagggttaatttggtatcagaaacgttttaaaggagtctttcgatatgagtaaattagttttgattagtcacgggcaactgtgtgaggagcttaagaagagcgctgaaatgatcatgggtccccaagacgatattgccaccgttgcactgttgccaaatgaaggtccggaagattttcaggccaagtttaaagctgctgtagaggggcaagacgatgttgtcgtccttgccgaccttaaaggcggaacgccgaataacgtcgcagcccgtgtcttggctgaaggcggcaagttcgacctgtattctggcatgaacctgccgatggtcatcagtttcctgaatgcccagatgttggacatgaagccagatctgatcggcgatggtaaggctggcattgcttatatcaatgacattgtgaagcattaatcagccaaaaggttcttggaaagctcgtgtcgagttgtgacgcgggctttttctgtacgctaaaattgaattgccttagttaacagaatggccttgacgtcaagaaaacagttagatttttcaataattgcttacttaacacaaaaattttgaaattttgtctgtgataacaaagcttgattgattccaagcttaaattcttttgaattgatatcaataacagtacaataaagaaaatcaatcctaagttgaaggtgggacctatatgggcgacaagtctgcaataattgaacttataaaaaatcaaattactgctaaaacaacacaactaacgactgataatattcaaaaaataactaatgatattcaaagcttacttaaaattctcaatgacttagcaacaattgaatttgttgctacatcctcagtaacacaggaagatgagacggcagcgctcacaactggtcaagataggacacaggctgaagaaagaccaatagcggttgctgaggtcaaagacgatgttgagccagttacaagtgagcaggtgccagccgcctccaccgaggcaacctctgaaaaagaagtgtcattcttttctgaacattggttggatcagcgtcacgcttacattggccggtttcaccttgatttaaatggtgggcatgtcggtccgattaaggtatcagagagtaagctacataagatggcaaatgcgccgacaaatggagattgggttaaggccgaggagattaaggacgacgagctgctgcgctacaaaattaccacgctgaaacgcgatcccttgccgaccgaaattgttcggctgcaatttttaccggctgtctatagacaagatgtcaaacgctggtatattgagtttcaatcgcctgagcacgaaactacccagcaattgttgctcggtgactacgatgtgctctcattcaagctgaagccaggcgattatattgactatgcttaccggcgggggcaagaaattgatggcaaaatcgtttggaagtacacggcatctgctgtagtcgccacccgaatgaaacgccaatttgccaaatctgcactagaagcatcggcagaaacaaagcctagtcagccagcgccagccaagaagaaggtcagcgtggcacctgtgcggcaactacgccaggttttcgccgataagtcactgttactcgtttgcattgaaaactccgccatgccgcgcaaggtgaaacggcatgttgaagaccgtggcggcaagctcattctctcgccgcgatcagattcgaacgccatgttgaagaaaaaggttcaaaaggccgacatggtcattgtgaccaccgattttgttgatcatggacagatgtatgctgctaaagacgaggctaagcgaattggcaaaccaatttggatggcaaagaataccaatgagcgaaacatgttgcaatggtataaacgtcattttggcaggcaaacggcggatcaagagattgagcaggcggctgaataaggggtgctgtataacgggacaagaaaatgcccattttcaggttgtgacgtgtgatcgtcgcctgaaaacgggcatttttttagaagagtgtggctgttggtgatttggccttgcgggactattttgggacaggtgcttcttgctgatgccaagtggcgtaaatcgcgagtattcgatctaaggcctctttgagtaatggccgtggcatgccaatattcagccggacaaaaccttcaccatcggccacaaaatagctgccgacgacacaggaaaggtcgcaagcggtgaagaaacgcttcaactcggcttcatcagcaaacagtcgtcggacatcgatccaagccagaaaaccagattcagctggcatcacctgcatctccgggatctcagcaagccgatcacgtaaataagcaaaattgtcagccacataggcgaccatttcatctaaccaagcgtcacacttggtataggctgcgatcagggcaggtatggcgaaactgttcggtgaagtgattgaattggcggcgaattgttgcgctaaccgatcgcgaatcccagcgtcaggaatgacaacgtaagatgtttttaatccgcctaagttgaaggccttattaggcgacaagcacaaaatactgtgatcgcgaatcgctggacaagcctgccagatgctagtgaagtggacgccgggataaacaatatcgcggtgaatttcatcacttaccagcaagacatggtgctgaaggcaaagatcaccgacctgttcgagttcctcagccgtccaaacacgaccagatggattttgcggactgcagaggatgaatactttcacatctggccgtgccattttgtcggccagatcttcaaagtcaaacacatagcggtcattttctagttttaacgggctggtgatgagctgtcgctggttgtgctcaacggcttcggcgaacggatcataggccggcgtgttaatcagtacactttcgccaactgccgtaaaggcttgaacaatataatgcaaggttggcaccgtgccgtaactcaatttcaaccaatctgcttcaagttcaagcccaaaacggcgcgcgttccaagcaataacggtttcgttaaacgcatctgggatataggtgtaactatagtcagaaactgcggcgcgggccataacggcatcgtgaatcggtggtgcaacaggaaagtccagatcagccagatccattggaatcgcgttaggcgttaggccgaacttctttgccaacacactatcggcccatttgcgcgcgttaccggctttacggtcaaaaagggtgtcaaactgactcatattcttggtcctccagtaacatcaagtctttgcttgtctgattcagcacctgtgcaccagtatccgtgattagaacatcgtcttcgatacggacaccgccgatgccgggcaagtaggcgccgggttcaatggtgaccaccatccccggctgcaaaaccgtttgacgctgagggttcagaatcggttgatcgccgcctagtccgagaccatggcccaatccgtgggtgaaacaatcgccataaccggcagcggttaacacgccacgcgcaatcgcgtcaatctctcgcgcttgcacaccgggttttaaggcatcaatagcagtgagttgagcagtaaggacggcatcatgaacggctgagagctcgggctgcggttcgccgattgtgagcgtgcgtgtcatgtctgattgataatcgttaaggacaacgccaaaatcaatcgtgatcaattcaccgcttttcagttgccggtcagtcgcccgaccatgtggcaaagcgccacgtgggccgctagcgacaattggatcgaaggccatggcagatgcgcccgcctgtaaagcatagaagtgcagccatgcattcagttcatattcgctgaccccggcccgaatatgcggtagcaaatgggcaaagacctgatctgtgaccatacaggcagccgtgatcgcttgaatttccacggcatctttgaccgctcgactttcagccagcaggctatcagctaaactcaacgtccaattctgtgcggtcagagtctgaaactcaggaatggagaacccggtactgacaagtgcgacccgccgacataattgagcgcttaaaaagctaacgagttccggtaagtattcgccttgcggtacttcaatattggtaaacccactggtgtcagccgcttcattgcgatatcggccattgtgaaattgtagcgcttgggtgggggtaaccaccacatacacgccactgccaggcaaggcaccaacgtagcgtttgctttgacgatcgtgcagcagtaaggcgtcaattgcctgcatcgtgagtgcttgttggatttttttcaaatgtgtcattttggcctcctaagggtgcgttaacttataagcgcgctagatcacgctctcaaacgcgttcaccagaccagaaacctgcgtgtaaggaccctgaacgcaatggcccaagcccggccatcacgttcagggccgcttacacttcggtttctaaccggtctggttcacgctcttaagcgcgccagttcacgctctagaagtctaaatccagtccagcgagggtgtcttcgtcttcttttgagaaaatggactttttcgcggcttttttggcttcgagttttagttctgcgcgttccatgaccttgaagaatggccagtaaagggcgacagccagcacgagttggagggcgttggcgaagatggtgcggtagtcgccgttggttaggaacccttcaaggaaaacgccgacatatggtggattgaaaatcggtttggcgatccagccccagtgcatgaagaacatcggcagcgtgccaatgatggcaccaccgaatacatgggggatgaacatgatcggattgagaatgatcggtgcgccaaacaggataggttcgttgatgccaaataatgccgggaacaacgaaattttgccgattttccgatagcgtttgctcttcgagagcatgcaggcaacgacgcagccgatggaaatgccgcaaccggtgaaaccgaagaaactagaaacggcaccagctgtgtaaaaatgcggaatggcttcgccggcgttcatcgcagcgatgttttcagcgataaacgtgaccataatcgggctggtgatcggggagaagaccgatgagtggatgccaaagaaaaacacggtacaaatcgcaaagttgagcagtaagaccgcccatggattgtccatgctaccgaccagcggcgccaagaagcgggttagaatacttggtggcagctcgccagcaaaattcaggaaggcaaatcggccagcgataaatgcgccaccggtgattaaggtgactggaatcagttcgaatgaacgggagacaaaatctggtaccccgtcaggcattttcaatgttaggtgatgggttttgcaccagtgatagagctcgactgtcagcaaggccacgatcatgccggtgaaaagtcctcgagcacctagattggtgacgtctaactgaccggttttagtgaacgttgcgaccatcatcaggaaggcaaaaccggacaaggtgacacagcctggaatatagagtttgtagtgattgcctaagttgtacgcgatggataaacaggcatacagaccaatcatgccgatggataacttcaccggcagatcgaacaagtcagcattgctagtgatgaaaagcgagacagcatttttaggaccgagcatgttaggcaacgccggaataatcgtgaaaatactgccgaggatggtgaacggtgtcatggcgaccatccccgccttgatcgcgcttagatgacgctgattgtcgaccttttgtgcgatcggcatgaagaagcggttcatgaaagactcgaattgactgaacatcgtgtaatcccctctcaaagtcgtaccgatgaaacgttagccagcgtgctttttttgatacttcgcatgggtcagcagtgctagtttcataaccgtggcaccatccatttggccatacacatccttatcaatgacagcaaatggaatgtgccgtggatcacagatttccccaatgtagccagttttatgaccaatctgtggtcctaccaacacgatgtcatagttatcgatttcttcttcaagaccgtccacgggaatcgcgtcgaatttaaaatcatcttcgtttaatttatggctatctttaaccaccttggccatattttgcatcaacatattggtggaaaagccaccggcacagcacaaaagaattcgcatcattattttcctccttaggtttaggtacggccattgaccgataccctgtcacacattggttttcgttgtttgggcttcaaaaatggtaatcaaagtttcaatcaaatcgcgtgcgagttggctggtcatgtagtgatcctgcgcatgtaccatcagaagactcaccggttccggcgtatgattaggatcaaactcgcggcaaatcattgccgtctgggctttatgagcggcaatatcaatcgccttagcctcagccaataagctgcgggctttggcaaaatcctgtgtttgcaccgcctgcaaggccgcaaatgccttggttttactctcaccggcattagcaatcaactgcataatttctaattcttgggtcgttgccattggggttaatctcctttagagcgcgagcaggagcgtttaggaatcggagtgtaagcggctttgaagtgaaagaaccggtttttggttcttttgcttcaaggtccttacacgtagattcctgcgactgcgagcgcgttttataaacagagcgcgagccagcccgcttatacgcaggtttctgggctggatagcgcgttttatcggtaccagacgatcaaaatgaacgagctttctccgctgttgccacggtcagtcgtcgacacattgcggcatataaagcgaccatttgatccacatcctgtgcctgcgctaacgattgggcacagtgaccatagcggcatggcagaattgtgacgacagtcggaatgccaacaccgactttatgggcttcaccaccgtcagtaccgccaccgttaaacatatccagctgcagcggcagggaggcagttgcggcagtttctttcacaaattgttgcaacgtgcgattaggtgccaaggtgcggtcaaagtgcgtcaggatcgggccgctgccgacttggcgttgattcacttcgctacgttcgcgcggattttggaaggtggcaacatcgacgataaatgcgagatcaggctggatcagttgagttgcggttttcgcccctcgaatcccgacctcctcactgctggtcgcggcaaaacgtaaagtaaacggtaactcatcttcagctaattcctgcagcaggcgtgcgccgacataacagcccagccggtcatcaagcgccttaccgccaaaaacgccatctgcagcatactcggtgaagtcagtcgaaaaagtgaccatgtcgccaatggtgatcccaagggctgcgacttctgctgcgctattggcaccaacgtcacatagaatctgatcaaatgcggccaaaccctcatcacgaatgaccatacccggcagtttttggccagaaaccgtggtcacgcggacgctttgccaatggcttgccagtggcttaacgccgccaaccaccatcaaccgtaacagaccttcaggcgttatcgtgcgcaccatatagccgacttcatccatatgaccgtaaatcatgaccgaaaacgctggtttaaccgttcgtttcgtgaaaatcagtgagccgaggccatcagtctgaacttttagatcgacaggctttagataatcgcgcaaaatggtgcgaacctcgccttcgttggacgcgattgcatctgcgttacttagcgcagccatcagttgtaaatccatgtttgctctgctccttccagtgccgtgcgtaaaatgttaatgaatcgggtgaaatcagtttggtggacgagttgctcgatgacatctggctgttgcattaaggctgctaattgcgttgttagtgtgcgatgcaacggtagctgatcgcgttttaatgcgattaaccagactaacttaaccagtcgagaactgccgccagcaccatttggcaagaccaccaccgcaacggcgttcttttcagcgttgaatgacaggggatgcggaatcgcaatgccgttgtcatagatggttgctaaaaagttttcccgctgcatcactgattcggcataatctgactgaccacaataagaagtcatggtggcggtcagtgcgagcaataacgcgtgataatctgccgcctgacttgtctggaaaaacaacgctggtgttagtaaatcgaccaacgtgtcagtattattgctgcgtgccgccattgatagttcgtgacgcaggttggcaaaatccagatcagatgccaattcatcaatccgaacgactggacagtcaaacgtctcggttaactcagtcaccgtgaacagtaaatctggttcaagctcatgaattgcagtgagttcattaagaccgaatgtctggatcacagcctcagggaaaatgcggcgcaatcgtaaacacaataacgtcgcaatcccgccgccagtgccacaaagaactgcgatcttatacagccgccgactccaagcctcgtgtgcctgttcgagcgggactaacagatgagtagtcaaataaccaatctcggtttttggtaccgctatttgatattcgcgagtcagccactgggcaaattggaccgcccagttgaacgcaatcgggtagtcacgggccaatggttccagacttaaccctgccaaactttgatgtttctgcaatcgtccgatcagtgccaacacatgaaaatacatgagcgacaaaaattcgggatgggtggcgaaatcagttttgtgccgcatatctaaagcggtgaaataagcttgcagttttgttttcaacaggtcgtggtccagccgtgtggtgagttgtttgtgtttcgccgcgaaactgacggtcaaaaattgccatgcttcttcactaagccgactatcggctaataagccagcaaaagccgctgtcgttggcgcaggcacggttgcctggcctttgaccgccagtgaccaaccaacctcgccagcaaactgcgccgtgattgctggatccaaccccaagggcattaaacgctgacacaaagtctgatgatgcggcggcaaaccccgttgttgtaaggcatgaatgcgactttgccattcgccttgaagtcggataccgtaatgtgccttacgttctaattgcagtggtgtgccaatcagcaacttttccagctcgcgtaaatcgcgttgcaactgttttgaactgatcagctcgtgctcggctaactgcgccaccgttagatactcggtcgtggtcagcaagacatgcattaaggcaggcaatcgtttcgccggcatggccggttgtgcttgatcttgcaaactagcttgataagcagcaaactgcgcactatcggtgatggtcaactgataacccacattgcgggtaaccgtaatgataaaaccggtgttgtcttcatttaattgccgcaaatcactttgcagtgttcgccgcgagacccccaacgtcgctgctaaagcagctgcggacatcggcccgttggtttgtaaagcgttgataatggtttgttcacgcaatgactcgccctccaatcagtaagcgcttccatcaacatcgtcattatgccggacaatataaccaacaaaaagtcccacttttgcacctgttgttggcaaaaatgtcaccattgcaagtttgtccagatgaaagctaagaaaccctgagcatgatgttttatctcgttatccgtcaggtagtttaacaacaaaacagattactgacgaggtgaaagcgactataatacgatgagaatcattacccgcataataaatagaataatattaacagcgttgtttcgttaattttcatctccaaagagtgttgtcaaaatattctgcagcaaccattggcgatgtttttatgcaaacaaaaaatcgtttctcagatgatttctgaaaaacgatttagtgagtaaatgattgatcgtcattgtatcaactgtatgttagccaaccgttccagctgcattcagttcggccatatgaaccaaggtctcagcaattttgcccatcgcttcagtcgaaactacttcataaggaccgtgaaagttgataccgccattgaacaggttaggcgttggaatgccttgataagtaatttttgaaccatcagtgccgccacggaatggaattgtcttaggtgtcatgccagccgcttgaatgccagcttcagctaagcgcagcggatagggatctttgttgatgatgtcggccatgttgtaatactggtcatgcatctcaactttaaaccgcggatggtcaaatggggcgttcaactcatcaatggttttcataaagtaggctttgcgcgcatcaaacttttggcgatcaaaatcccggataatataaaccaactgagcatcgctgatttcgccatggaatttcagtaaaaggaagtaaccttcatggccgtcactgaattcaggtcgatcaaacagtggcaatgctgcatccaattgccgaccaagtgtattggcgttaatcatcaaatccttcgcctcaccgggatgaaccgaagtaccttcgatggtcaccgttgcctgcgcagcgttaaaggtttcatattcaatttggccaggatcgccattgtccaaagtgtaggcaaaatcagtcgcaaatcccttggcatcaaatttatccgcaccagtcccgatttcttcatcagggccgaagccgaatttgatcaagccatgcttcacttccggatgagccaacagataacgggcggtggataccgcgccagcaatcccggctttatcatctacccccaacaatgtggtgccatcaccggtaattaaagtttggccaaaataccgtttcaatgctggaaactgctcaacagtcaggctcaggccgttatcaaaatgaatcggtttgccatcgtaattaggatgcacttgcggttgcacattttccgcattgtaatccgcggtatccaaatgcgcgatgatcccaaaactttttgtcggcttgtcagtgttggccggcagtgtggccgtcacaaaaccgttagccggattaagaccgacatcttggagtcccaagtccttcagttgtgcgactaaaagcttagccaattcagtctgccctggcgttgatggtgtggtgtcacgccctggataggagcgtgtattgaccttagcgtaccgaataaagtcagcttgtaactgtggcaaatcaatgtgtattgtcaatgaaatccctgcctttcaatgagaaaaatattaatattgcattgcaataagtttggatctggcttagtattttgtcaatagttgattgttaccgcgatttttggagggaatacatatgtttaagttaaaaaaatggacactgatgttgccactcgctgcattggcgttggtagctgctggctgttcgtcaaacagcagtagtagtacaagtcaatcgaagaaggctcagacgctaaattggtcagaaatttcttccattgtgaccaatgatccatctatgtcgacagataccgtgtcttttcaaatgatgacgaatacgcaggaagggatttatcggctaacagacaaaggacaaaagactcaattggctttggccaaaaaggtgaccactagtaaggacggcatgacttacaatgtgaccttgcgtaatgcaaaatggagtaatggcgatccgatcacggcacaggatttcgtttatagttggcaacgcacagtggatcctaaaacgaaggcaacagatgccttttacttcgcgccagttaagaatgccagtgctattattaaaggcactaaacctgcaagtgatttagggattaaggcgacagatagcaaacatctgacgatcacactggagaatccaacggcttacttcaagaaaatgttagctttcccattatattatccgcaaaaccaaaaaactgttgagaaatatggcaaatcatacgggacaacatcatctgcgcaggtttatagtggtccatttaaattaacaaaatggaacggcgccagtgatagctggacattggttaagaatccagaatattgggacaaaaagaatgttaagttgagcaaagtcaacgagacagtgatcaaggatgttcaaacaggtatgaacctttatcagaccaacaaacttgattcaattgttctcactggtgagcaggccgcggcacatcttaatgataaggatgcgattaagcgtctgtcatccaatatgacacgagttgacttgaatcaaaaacaggtaccggcttttaaaaatctcaaaattcggcaagccttttcaatggtcgttgatcgcaatgcggtcactaagaacgtcttaaaggacggttccaaaccagcgttgggcttcgtgccaattgggttacagaccaaccaaaaaacaggtgctgattttgcccagacaacgcaggtcaagagtgctgttgcttataacaaggcaaaggccaagaagctatttgcagaaggtatgaaagaatctggtcagagtgagcttaacctgacgctgttggcagacgatgctgacgtttctaagcaagttgctgaatacttacaaggggctttcgaaagtttgccgcatgtcaaagttacgattaagagcattcctaaggcgcaacggttacaagccatgatgtctggtaattacgatatggttgtgactggttggcaatcaatcttcgccgatgcctacaacttccttgatgtttggatcagcaattctggctacaacacttctggttataaaaataccaaacttgatcaattacttagcgaaactgagactaagtacggcaatgaaccgcagaaacgttggacaatgctgcaagatgctgaaaagatcttgatgaacgatcaaggcacgttgccactgtatcaggcgaataacctgcaactgctgcggccaacggtcaagggcgtatcgtttaatccaaacggcaccccgtatgacttcaagacggcgtatatcaagtagtgaggagcattaaatttcaatcaaaatagcgcatcatgccgctggggctttccccagtaagcatgacgcgctatttttttgagtgcaagccagcctagttagaaaccggagagtaagcggttttgggtgtgttgaccaatgcgactacggtcctgacacgcaggtttctcggctggggaactcgttatggtagacggcgatgcatgttcacttcaaaatctattcatggctggcatcacgactttaacacagagtgactcaaaatatagaaggcttcctgactagcttggtaatctttcgttttcgccggaaaggtggcatcaaattgttcagccgcttctttgtcataactcatcgccggactctcgtgataagtccactttctgccatccaatacatttggctcgagctctttcacaagcatcgcggtgggctgggtgttatctgcagcccaaacgttgaacttttgacaacttttaaacccgcgctcgacatagttgtctggatcgccaaaaatcacgatggtgtcgtaaccaagttcagtcgcgcgtttcatagacgtttccatcaattgcttaccaaaactctgccgctggaaggctggatctatggcgaccggaccaaacgtcagaatcgttttctcattaccattttcatcaactaacttggccttcgtgtacataatattgccaatcacttgtgcattgcgttcaagcacaagatccagttcaggaacgaaatcggcatgatttcgaatgatatgcgctaaataatgttcatcagcgccggggacataaagattccagaaagcattgcgatgaatagtttcaacttggcgataatctgacggttgttcggggcggattgtggttttcatggggatggcctccttaaaagggcatgatgattaataatagctttgatcattacttctagaaaataatagataaaaatatgtggaacaaaaagaatgatatatgcgccattttacctagagatgaagtgcttgtaaatttcgaacaagcttttttaaaaagcagtatagctgtcacgaaggcatcacggaatcggttattctgatagactgattgcaacacagaaaaggataatgagcggtggtatcggatcagagaggtggtggtgcgtatggggaaacctatcagccacacgttgaagaaaaaggtacacaagcttgtctgtggtcgctgcattaacgacgatcacggcctgtgtggtttcgtgcgtgatactggtggctgccttaacaaggctagtcaaagccagtaccagactgctactagcagtggccgaattccgcagggcgctcgggcaactccgagaaaaataggcaaactaaaagccgcgcatccttcaggggaatctcgcggcttttagttgcttgttccaacagccatcgttcattagatggttctgtgagggcatttctgcccggccgtcgcggttgcacgcggcggctttttctctgacctcagtatagcatgacttgtgagcttttttctagtggataaatcattttaagcacggcgaacaccaatacgttgatatcaaattcagtatcaggcttctgcgccagtgagcgcattttagcagtggccgaatgccaacaggcgctcgacaaagttcgagaaaaataggcaaactaaaagccgcattccttcagctgggataccgcggcttttagttgcctattctagcagccatcgttcattagatggttctgtgagggcatttctgcccggccgtcgcgcgggaacgcggcggctttttctgtttcaagaatagcataacttgtgagtctttttctagtggagaaatcattttaagcacggcgaacgccaacacgttgatatcaaattcagtatcaggtttctgcgtcagttgacacttgcctgctagcggttccaaataaaacatgatatactccctttacaatcgaatagaaacatttggggtgctgtaaagctgagatgatacccatggaacctgatgcagttaggactgccgcagggaaatgtcgaagaagtgaatcgttctgtaacgatgcttgtttgtgttttcatgggccccaccaaattttggtgatgggtccttttttgaacatgaataggtgttggcgtgattggtaatgattcgcgtttttagcccccgtctgtctttatttgaggaaaacgggggttattttgatggataaatggtctttgcgcgatgtggttttgctggcgtttttagccttcctcttcggcggtgttttcatgggtgccgatgcgatttatgccgttgtagcagctgctttgacaccgctgggttatgcaccgtttgccaatgaattgttgtttggcatgtgggtgatggcggcgccgatgacgacgatgctgttgcgaaaaaaaggcagttcaattttaggcgaatgtttcgctgctttagcggagatgctttacgggtcgtactttgggccagcagtcttgctttctggatttgttcaaggtttgggcagcgaggccggctttatggtgacacgttatcggcgttatgacgtcgtgagtcttttgtacgcagcgattgggaccacggtgttcagttttacctacgagtatttcaaacttggatacggcgcttacagtcttggcatgattttggcgcttgtggtggttcgcttgttgtcagtgatctttttcggcgttgtgctggtccaactcgttctgaaactttatgaacaggcggctggtgccaagcacttggctagcaggtagcggcaaatgagtattgtgttaaaagcgatacggtttcatcgcgagacggatttgtttacggacttgaattttgaatttccaacaggagcactaaccgttttaaccggtgatagcggcagcgggaagtcgactttgctcagtttgatcgcgggatttgcagcgatgccatacgaaggcacgattttgctggatggtcatgatgatcggaacgccgcgatgcaagtcaaagcacagcatgttggcatgatgtttcaaaaccctgaccaacagtttacgatgcgaaccttgagcggtgagttgtcttttgccttggaaaatctaaatttgccggttgccgaaattcagcggcgctttgcccaggcggttgcccttggggagactcaggcattgctgaatcgtgacttgagtaccttatcaggtggcgaaaagcagcgcgcggcgttaacggttttgctggcgatggatgcaccgattttgctactggacgagccgtttgccagcattgatccggcaagtcgccatgtgctaattggaaaattagggacgttacgtgatcatggcaaaacaattgtgatcgcagagcatgatctgacagattatgccgatgtggcagatcaactggttgacttgaaaaatggcgagctaagtcggctaccactcgcaacgctgaccacgctaccgacgcattttaacctcacgcaaccacggcaggcgaccaataaaatcttccatctggaaaacgttgtctgccagcaaaatcaccatatcttgcttcaagcaccgagttgggattttaacgatggcatcaccaccttgactggggccaatgggagtggcaagtccaccttattgcgatcaatggtgcagctgcatccctatcaaggccgtatgttccttggtcaacaacgcttacgtcgccggaaacgactttatcaaaccatgacgctggccgtgcaagacgcggcaaaacaatttgtgacgttgacactggcagatgagctagcgtttgggccggcgttaccggccacggtgcgggaaaaacagcaagccgcattagcttatcttggactagcagaaaagcagaccactagtctttaccagttgagtgaaggccagaaaaagatggttcagttgatgacgatgctgagcttagatttgtcatttttactactagatgaaccatttagcggcttggatgatcgcgcctgtcagtactttgccgcgtggattaaggctaagtcggccacgcaagcgtttttgattgtgacgcaccgattggcaccgttagctggtatcagccagcaacaggttttgctagccaatcagcggttgcaggttgtgcaggggtgacgtgatggcacagaagaagacagatgcactcaacttgagcctcttgattctagccttaacactagagatttcgtttagtcacgcggtgaagctgaatgtcgcgttgatcgtgttagcactgggatttcttgggtggcggcgagcctttagaagcttgatcgtgttactgctgctgccgttgatcccagccgcgagcagttattgggccatcacgcttcatgcaacagacacatcttatgcgctgttactgtttgtccgaacatacgcatttacggctttgggcttggtgtttctcactggtgttgatttggaagcgttgttgttgtggcttgagcagcataaactatcgccgaattttgtctatggattattagtggtcatccatgccctgccgcaaatcatgcgggaagtggctgatcttcgggaagcgagtctgctgcgcggtcagaaactgcgtccttggtcgccgctgatttacgtcaaggtcatcttcgttgcgatggcttggcaggatcagtatgtgaccgccatgtatgcgcatggctacacagaaggcggttcgcgaacggttcaacggcaattgatcagttcccgccgcggtttgttgatggcaggcgcagtgttcgtgatggtgaatcttattggccattaacgtcataaaaaacttgattctagtaaaaatactgtttttaggctttgaatatggtcaagatagatagaattaaaggagcaaacgatgatgaaattttctgaaaaagctcggcagcaagttgttccgtactgggaaggcagcttcactcacccatttattacggagctacaagctggcactcttgatccggcgattttccgcttttatctgattcaggatgcttattatctgcaacattttacacatttatatacgctgattgccgcacagacgcaggagccggaattgaaagcttatgcgctgcagtcggctgaaggtttggcccaaggtgaaattacgatacgccacgattttttcgccgaattgaacatctcaacaactgagctggcggccaccacgattgcgccgaccacgtatcactatgtttcccacatgtaccgacaattggttgaaggcacgccgcatgtggcgattgcggggatgctgccatgtccatgtttgtatcaggaggtggcacagcagttgcagcaacgaaaatcacccgtgccgatttatcagcgctggattgacacttatagcggtgcggacaacgcggacgatcagcgagcggcgattgcgttgattgatcggttgtacgaccaaagcatgccgactgagcagcaacaaatgctggctgcgtttcggatcagcagtcaaatggaatacagcttttgggagatggcgtatcacttagaagcgtggccgaaaggagcaaaggttgatgacacaaagcagggttaagaaactggcaatattagcgatgatgatcgccttggatgtggtgctttcacccttatttcgtattgaagggatggcacctatgtccagcgtggtcaatgtcgtggcagctgccatgatgggaccgctatatgccaccatcatggcctttggttgtgctctgattcgcatggcgttattggggattccaccgctggcattgaccggtgcaatattcggggcgctcttagctggcatcggctatcgttttggcaaacacaattggtgggccgccgctggggagattcttggcactggcttgatcggatccatactgtcctatcccgtgatggtttggttcaccggcagcgcccaatcgctctactggttcgtttacaccccacggtttttcggtggatcgatctcagggtcgttaatcggcttgtttgtcctatatgaacttgatcacattggcatcactaaacgcattcaaaaaattttctaggaggctttttccatgtcaaaagcaatcactgacgttttttacaccgcgttcaaaaccgccctgccattaacatcatccccactggtgcaatgcattaccaacgaaatcaccgtcgaatccatggctaatgcattgctttacattgatgcgaagccggtcatggctgatgatcagcgcgagttcccggaattctttgctcaaagtgatgcgttgctgttgaatcttggacacatttccgaagtgcgccagcagaatctattagccgctggcaagtttgcgcaggccaccaaccagccaacagtgattgatttggtcggcgtttctgccacccagttgcgctatgatttaggtcatcaattgttagccaatcatccgaacgtggtcaaaggtaacatttctgaaatgcgccgattcgttgatctaaaaagtacaggccgcggcgttgatggaagccagttagatcaaagtgcgaccgccttgggagaactagccgcgagcttgcagcagctgacccaagcgtttcccaccactaccttcttggcaaccggcaagattgatctcgttgtgagtgcgaaggggacttggtatttgaaaaatggggtgccgcaactggatcgtttcaccgggactggtgacattgtcggtgccttgattgccgcgctgttggggacaggtttggacaacgacgcagcagtcgtcgtggctgtgagttacttcaactgctgtggcgaagtagcatctgcgcagaatcgaaccggcggactggcggcatttcgcgaaggtaccttgaatcaactttccttactggctgccaccgctgactggcttcaaatggtgaaaggggaagcgttatgaacgcaacagatctaaaactgtacttagtcacccatcgttacgatgacaacgaagcaacttttttggctaaaatcgcggctgcttgtgaaaatggcgtcacgatggtgcaattacgcgaaaagatgctgagcactcgagcctattttgaattggcacaacgggttaagctcatcactgaccgttatcagattccgctgattattgatgatcgcgtcgacatttgtttagctgtagatgcagctggtgtgcatatcggcgatgatgagctgcctgttgcgatgacccgccagttgatcggtcctgacaaggtattgggcgtttccacaaaaaccgtcgagacggcggttgccgcggttgctgctggcgctgattacttgggggttggcaccatttttccgacgcagacgaaggcagacgcgccagtgaccccgattgcgacattaaaggcgatcactgcacaagttgccgtgccggtcgtggctattggcggcgtcaaagaagccaatttagcgacgtttaaagataccgggatcgccggggttgcgattgtgagcgaaatcatgcaggcgcctgatatcgctcacaaagttcaggctttgcgcacaaaattaaaggcggtgttaccaaatgaccgttaatcgcacaccgcaagtcgtcaccatcgctggctccgattccggtggcggggcaggattgcaagcggatttgaaaacttttcaggctcgacacgtctttgggatgagtattgtggtagcactgacggcgcagaatacgtatggggtccaggccagtctgccgattccggggggcttcattgacgcccagtttcaatcgttagctgctgactttaacattcgcgcggccaaaacggggatgttagcggatcgtgagcatgtcgaagccgttgtccgcaatttgcaacaggttgattttggcccgctgattgtcgatccagtgatggtagccaagggcggcgcgacgttgcttgcctcggaagctgtcgtcaccatcaaagaacagctgctcccgttggcggatgtggtgacgccaaatctacccgaagcagaaattctcgtgggtaaaaaaattgtgaccaatgcggatatggttcgggcggcgcgtatgattcaaacacttggcgtcaagcatgtcattattaaagggggccatcgtcagaatcacaaggccgaggatctgattctattggctgacggtacgtgttattggctcagtgcgccacgaattgccactgcgaacacgcatggaaccggtgataccttctcggcatgtatcgctgcagagttagcaaaagggcagccattaaaagcagctatcatgacagccaaagcctttctacaaggcgccatcagccaaggcatttcagtcggccatggtcatggcccgacaaatcactgggcaaagttgagtgaaaaagtgagtttgcgtcaaggttaagaaggggtgccgaagatagaaatgtcttcggcgttttttgaaaaagtcgattttttcaatcatgttgttgtgaaacgttgccaatccctgcaaaataaccacgcaaagcctgatcactactgatagttgtgttgtgaaacactatttttctagaccagtttccgctatactgacatcaaggagggcgcgatgcctttgatggcggatgaacgtgacgcttcaatggatggtaccaattcatgacctgccaagttggcggccattttggggaacacgcctagttactagctagtcatcaagaggctatcaaaccagcctgcatcccgatatgtgaccagtaccgagctacaggcgctcttagtttgtatttggaggctttgaattgtgcaagaagaagaactgacgccccggcggtatatgagctggccagtcttaagcttacttgtttttattacggtcattggctttgaaaatattttttatccttttcagaaccaagggctttccgttgttgttaactgggtcatcctgttagtgatttatatcgtgccgtacgccttgatttcggcacaattagggacgacttttacccgggctgatgaaggcggtggcttggcgacttggatgcgtcgcacgctaggggacacttggggatactggacaagttggatttattgggctcagaccctgccatatttagtcgatgtttccaacgctgtcatcgtggcgctttcctggatgattctgggtgataacagtttgggtaaacgaatgtcgaatctgacctttggcctgctgacttttgctattattcttttatttattgtgttagagaacctgttctcccgatcacttgaagtcatgtcgctaattggcggtgcggcgatgtttttgatggcggttttattcgttgtcttgacggcggccggtttggccaaaggcatgcattcggcaacaaactttagttgggccgcgttcaagccacatttttcgctgcattactttgccacgaccggactcttgatttttgcgacatcaggggcggaacttggcgccacttatgttgctcagttgcgcaacccgaaaaaagagtttcctaaagccatgtgggccctggcgctcatgaccggttttctggtgatttttggatcgttggcattaggcgtttggttcaatgccaaccatctgccagatgatctcaaaatgaatggcgcttattatgccttttccatgcttggtcaggcgtggggatggggcaaagtgctgatgtatctgtttgccatcacgcaattgctcttcatgctcgcccagctagcggtgttgattgatgcttccagccgggtattgtcagccgacaccgctatgcggttcatgcctaaatggttgttgcagaaaaacaagcaaggtcggccaatccatagttatatttttaccgcctcactttgcctgttcttgctgttgctgtcagggacgctgccgaatattaatgccatcttcaactggttactgaatttgaatggtattgtatcgccatacaaaacggcgcttgtctttgtagctttcttggcattgcgggcgcaagcagacaagttcacttccggctataccttcatcaaaagtaaggccggtgcttatctagttggcggttggtgttttgtcttcacatttatctgtgcgacgctcggtttcttaccacaggaagttgttttcggaaccaatggctggacccatcaactggtgatgaatatcatctccgtgatggtactctttggttttggcttcatcatgccgctgttagcaaggcgtgatgttaaaaaagaacggctcatgtaagccaatctaaatgatgaggcgtcaccacgatgttgcgggtgatgtttcatcatttttgaatacgcattcaaaatttaacgacattttcgtagtcaaaggacaataatgatggcaatttcgacgattatcggtctattgacgacgtttaaaaaaggaagtgccatcactttgatttgtattgtacattcttcttgaacagactagcacgcaatctaaatgtcaaagggagaataatccatgaacaaagtgaattggcttatgataaatttgcatattgaaggcatgaagcaagaacagggtcagaatgatgtctaatgagttgagaagtgattggaaagattttgccgcgacagcaatatcgtttttggtatcaggggcgtttatggttttcctaatcatgccaattcccggttttcaagaggatttggtgttgtcgggcattttggctgctatcatctacatcattgtcctcatagtcacattgttagcgttgaaaaaagatgaaatgaaacgctttatcagcttcttcaaaaggcagaaatcggatatgtgactaagcaaccacctttcacgctaaaaggaaggtggttgctttttttattaaaaaagttccacaagcttatacaccgtttcacgagtgactcggcttcattaagaaaatctgttatacaacagaaaaacgaaagacccaatacagatgcgtctctcaactagcagttcccgaattttggcctaagttttataaacacactttttagtatttgatgaggcagtctttatacaggatatgccctctttatgctcatattagcctattttgtttcatgagaaatgaatcttagcagttgacagcgcttccaaaatcaggttaagctgatcttgcaagattaagtaaaacgttttacctagcaaatgatttaggtcgtggacagcatgaaaaagaagatttcgattactgatgtggcaaaggaaactggtttgtcagtcacaaccgtttcacaaattttaaatggtaaaggggaacggtttagcgaaaaatcgcgaaaacgggtgcttgctgccaagaaggcgttgggttatgaaccggatttctttgcccgtgggctggttggtaagcgtggcaactcaattggtgttgtgatacccgatatcatgaatcccttcttcgcgagttttgtggtcagtgtcgaaaaggcagccattccacagggactctttccacaaatcttttcaattaatggtttccatgagaatgttgattattttattcgtcagtttttaggtggtactcagcgtggcttgattttggcggcgccagaagcatcacaggagatcgttcaaaaagtggaagatcagctccatctgccaatggtctttatggatcaggctaccacgctgacatctggcgacagcattcgtattgatgattttcatgcaggttttcttgtcgctgatcatctcattaaacgtggtcaccgccggattgcgctagtattgccagagccgttgacctttaatctgcgggatcgtctcgctggttatcaacatgcgttcgattcacataatgttgcacttgatccgcagttaatcttccgcgcaacatttgatccggaaggcgggcgccaggctgtcgaccagatagtcaaaactgatgctactgctattattgcgatcaatgatgatgtcgcaagcggtgtttaccgcgggctgtatgagcatcataaacggattccagaggactacgcggtggtgggcttcgatgatgtctcacaggcgcgatttatgacgcccgggttaaccacgattgcgcaaccgattgacgaacttggccaacgcgcgatcgacatgttgctggcccagatggctggtgaccatcaagatcgcaacgtgattgaactgccagtgaagttgattgagcgcggatcgacaaaacggatttaaaacataacgtgcatcttaaaaaaatagggtgcagatgccgaataagaggaggcgttttgattgaaaaaaggaacggttattaacacacaactgtcacaagtcattgccgatatggggcactttgatctactgggaatcggggacgctgggatgccggtgcctgaggatacttggaaaattgatctagctgtctcgaaaaatctgccgagttttatcgatgttctgaagaatgttttgtcagagttacaagtccaaaaggtttatctggcagaagaaatcaaaactgaaaatccggaacaactcaagcaaattcaagaactgattgatgtgccgatcgcgtttatgccacatgatcaaatgaaacaagacctcagcaaaaccaaagccttcgtccgcactggcgaaatgacaccttattcgaatatcttgttggaaagtggtgttacgttctgaaatagagtgtgagccaggcgaacgcgtttagaaaaagcaagcaccagcatgtacttgggggaatcacaatgaagatcgaaatgaagaagatcaccaagagttttggcgccaatcgggtccttgaaggcgttgatttcaccgttgagtcaggtgaagttcatgcgttgatgggcgaaaatggggccggaaaatcgaccttgatgaatattctgactggtttgtatcaagcaaacagtggcgagattctggtggatggtcagccaaccacgtattcagggccgatggaagccgaacagcatggcatcagttttattcatcaggaaatgaataattttctagagatgtccgtggtcgacaacatgtttttgaataaggaactgcgcaccaagtttggcttaatggacaataaggcaatgcgcgaacaggcggcacattatcttagtctgctcggcgccaaacttgatgttgaacaaccaatcggcaacttgagtgttgggcgtcagcaaatggttgaaatcgccaagtcactcatgaccgatgccaaaattatcatcatggatgaaccgactgcagccttgaccgaaacggaaattgaccagcttttcggggtggtgcggcggctcaaggaaaaaggtgtgggctttatctatatctcacacaggatggaagaaatttttgaaattgctgacaaagttaccgtgatgcgtgatggtctgtcaatcaccgaatacgccaccaaagatgtcaccatgaaacaactagtcaaggacatggttggtcgcgagattgacgatttttatccggatcgtacgcctgatcacgggccagtggcgatggaagtcaaaggcttgaccgaaaatggcgtgttcaaggatgtcagctttacggtgcatcaaggtgaaattcttggtttttcaggattgatgggcgcgggtcgaacggagatcatgcgggcaattttcggcattgataaataccagtctggtgaaattttattagatggcaagccggtcaaaattcgcgatccgcaagatgctattcgccataacatcggctttttaaccgaaaatcggaaagatgaagggcttattctagaagattcgttgcatgacaatatcgttttgccttcaattgatggcttcgtcaaacatggcttagtggatgataaggcaacagatgaatttgttcggatgttaatgaaaaggcttacagttaaggcgatgggaccggatgtctccgcaggcagtcttagcggcggcaatcagcaaaaagtcgttttggctaaatggatcggttccggctcaaaagtgttgattctcgatgaaccaacgcgtggtgtggatgtcggggcaaaacgcgaaatttatgacttgatgaatgaactaaccgatcggcacgtggcgatcatcatgatctccagcgacttgccggaagtattgggcatgagtgatcgcattgctgttgtgtatgaaggcaaaatcattggcattttagatggaaaaaccgcgacgcaagagtcgatcatgacactggcaacagggggagtggaagagcatgcaggagcaatctaaagcaaaaacaagtagcaaaattgatgtgaagaaaatttttagtcggttaggaccgttattggcactggtggtactggtcattcttgtgacgatcatgagtcctacctttgtatcgccggctaaccttttaaacctgttacggcaagtctcgattaacgcagtgattgctttcgggatgaccttcgtgattttgaccggcggcattgacttgtctgtcggttcaatcttggctttatcaggggcagtcacagcatccatgcttgccagcggttttgcggccccgcttgcgttactggcaggcctcgtcctcggcgccattttcggcttgctgaatggtatcttgatcgcttatgggaaagccgcgccatttattgcgaccttggcgaccatgaccattttccgtggggccacgtacgtgttcaccaacgggaatcccatcactggcgctaaaatgaacagcagtttcttattccagttcatgggccgcggatatctgttgggcattccattcccgattatcatcatgctcgtggcttacggtgtgctgttcgtcctgctacacaagacctcttttggtcggaaaacctatgccttgggtggcaatgaaacggctgcccggatcgctggggtacgcaccaaaatggtcaccatgctgatttacacgatttctgggttaatggctgctattgccggtatcatcctgacatcacggttaagctccgcgcaaccagatgccgggacatcctacgaaatggatgccatcgccgctgtcgtccttggcggcacatcgctggccggaggcaaaggccgcattttcggcacgctgattggtgcgttgatcatcggcacactgaacaacgggatgaacttactgggcatttctagtttctaccagcagattgtcaaagggatcgtgatcttgattgcggttctgctcgatcgccggtcttctaataatgggtaacaaaacgtgagcgcgtgctcgcggcaaaagacaaaactctagggggagaaattgacatgaaacaatcactcaaacgctttttaatggtcgctgttgttgcgacggcagctttattcaccttaaccgcatgcggcggcacaggactcagctccaaatcggacagcaacacaaaagtgaccaagaaagcgcccaaagatctgaaagttggcgtctcactttcaacgctgtccaatccattcttcgtttctgttcgtaatgggatccaagatttagccaaaaagaataaaaccaatgttcaagtttccgatgctcaaaatgataccgctaagcaaaacagtaacattgaagatttaattcaaaagaaggttgatgtactgatcatcaacccagttgactcaagtgcgattacaccagccgttaaagatgccaatgatgccggcatcccggtgatcaccgttgaccggtcgagtgacggcggtaaagtgttgaccttagtcgcttctaactccacaaaaggtggtcaaatggcggctaagtatatgatcgaaaaacttggtaaagacgctaaaattgctgaattgcaaggcatcccaggtgcatccgcaacccgtgaacgtggtaaagggttcgatggcgccgctaaaggcaaactcgatatcgtgtccaagcaaacagccggctttgaccgcgctaaagggctgaccgttaccgaaaatattttgcaaggtaatggtgacattgtcggtatcttctcgcaaaatgatgaaatggcattaggggcggttcaagcagtcaaagccgctggtaaaaagatcaccattgtcgggttcgatggcgaagcggacgggattaaagccgttaaggccggcgacatggctgcaacggttgcccagaagccagaagaaatgggtcaattggctttacaagcagcctatgatcatttcgacggtaaaacggtgaagaagaacgttgaatcaccattgtcacttgtgacaaccgaggatgcgaacaagtaagcttcatgctacgcttaaaattaaccggcactttggtagttaagttagaaaaaggggccgacttatcggccctttttaattagagcgtgagcaggccgttttctggacgagcgagcgcgtttcaattggaggaaatcttatgcctaatcatgttgttgtcatcggcagtatcaatgtcgatagcatcttgcacattcaacggttgccacaaccgggagaaacgatcaaaatggacaccttttcgcaagcggctggcggtaaaggggcgaatcaagcagttgcggctgcgcgttcgggagccaaaaccagttttattggccgagttggtgacgatgccaacgctgccttcatgcgcggtgaacttgtcaagaaccaaatcgacactcaatatgtggcgacaacggttggcacgcaaaccggtcaggcttacattttgctgcaagcctctggccaaaattccattatcatccagcatggcgctaattttgaggtgacaccagcagatgtgcaacgagcagccgacttgattcagtctgccgactttgtagtcgcggaatttgaaacaccggtggatgcgacggcagaggccttcaaaattgccaaagctgctgggaagatgaccatcttaaacccagcgccggcacagaaggatttgccagcagccttgctgaaaaatgtggatctcatcgcaccgaacgaaaccgaaagcgagctgatcaccggcattccggtggtagatgaagacagcatgcgggcttcggcagcttattatcatgaattaggcattcgcggggtgatcatcactttaggatcaaaaggctccttcatctcgctggatggcgaagcaaccatcgtgccagcctttaaagtcaaggctgtcgataccaccgcggccggcgacactttcattggcgccttggccagcgtcttgcagacagacctcaagaacattgtcaccgctgcgacatacgccagcatggcgagctccttcacggtccaaaaactcggcgctttcccgtccattccgatgggggatgaggtgcgggcggcgttagcgaaaatcaagtgaggttataacgagtaaatcactggatcaaaacctaccttaatcaaaacaagaaagctggcagtcgtgcttacctcacacgattgccagctttcttgttttagttgaactgagagttgatctatcgcgccctgattatacgtttggtagatcgtggcgcttggctttaccagccgtaatttgcccgtccccacggcgaattcgggccatcggttctgggttattaagcaaatacatcgtttcttcgttagcgtcaaaatcgcgtttgctcatcaccacaacattgtcgtctggattcttgaaagtgacgactaatgggatggcatcttcattgacttatttcaggtggtctttaagatgctgcttgaaatgatggtagctcattgcatccatgggggtcatccttactgttattcaaacctaataaagactagcaacataaggcttcatcgctgtcaccacatcgtcgctgccggtaccttcaatcaaagctaccgtgagataggtgttcttatcggcatccatggcgactaaaaagccattttctttgccgtcagtgtcttgcttttgcttgagttcggccgtgccggttttagcagcgatggtgtggccgtcaattgcgagattgtgggcggtgccggcttgatcagaaaccacgtgggttagcgccgttttaaccgtattagctgcgttggcctgcaagacactgttggttcgtttgcctttcgtgccttgaatgagggtcggttgctgcatggtgccgccattggcaatcgtgctgtacatcgcggcttgttcaattggcgacaagaggagttgcccttgaccataggcggtatcggccaaaagggtttcggaagcgagcttaccagagtttgaaatctgggcttttttcatggtcagcggtaagtcggcctgggttttgaaaagcggtgcgaggcctttgaggtaagcggaggcgcccattttcagtgctacttgggcgaaccagatgttatcggaattgaccaaagcctgcgtcatgttttcagaggcggcatcgactgtgcgtgttaccttgtagtcaccccaggagctgtctttttgccacttgagaccggagatggacttggtggtgtccggggtgatcgtcttattctgaagggcaatcgctgccgtcagcatcttaaatgttgaaccgggcgcatagcgttgcgcgaaacggctgaggaatggtaacgaggtgttgttggcatacttatcatagtccgtctggctgatcccgttgacaaaggcgtttggatcataacttggcgagcttgctaaagtcagtagttcgccattggtcggattcatcgtcacaacactaccagccttgccagcaagttgggtgtaggccgtcttttgctggttggcatcaatggttagcttcaggcttttaccattaacggcctttttagttaaaagcgggtgaatgttgtcgccgttttgaattgaaatctgaccaccgtctgtgccgcgcagttgtttgtcgtaaatttgttccaacccagttttgccaattttgctattagctgttagcgtcggatctttgcgaatgtcatcagccgtcgcggtaccgacgtagccaatgagctgggccgcggcttcgccaaggggataggtgcgcgagccgatcgtctgataggccgcgcctgtcatgactggtgaatcagtgacgattttgacaggcacgaaggtatcatctgtgacccaagattgctttaacaaggtttcaagactagtgaccttgacgtcccacgcggcagcaattttctctaagttggctgtgcgatcggcaccggttccgagcttaccgggaaccagcccagcttgggtcacatcgccattttttgccagcaactggttattgcggtcataaatctggccacgggtggccgcaatcaggtcaatctgcaccgtgtctttgccatccattgacgggaaaagcagacgtggcgaccactgtattcgccagttatcgccgactttaacaatcggcgcttcgtagtgttgcgcactcagcttgccgattttggtgttcatgttggctgtaaacgtcagctcgtaggttttgctgtcgtacttcttggttttcacgttagtaatcttgatatcactggcgccaacccgatcaaaaactgcctgattgcgcgccgccaaagttttggccgtataatgccaaccaggtccagtcaagtggctggtatcaacttgtttaactgctttgtcatattggcgcttagcaaacgcctgcgtataagtttgcgcagtggcctgaaccgcgtcagcttcggttttgccttgataccaatgataaaggccaaatccgccagcaatgatcacaatcgccgcggccacaccgccaataatggtgagggtcgatttcttcatgatagtttccccatttcctgattttactccgtgtatatggtcattctactcgttcgagtattgtgaagaaatggtgatgagttaaattggttgaaaggttggcgttaaagatcagtaaatttgcttgcgcaagcaaataaaacagcctataatacttcacagggaggtgagtgattgatcaaacgctggctcatactcatcacacttggtttattcttctttatggtgattattgatggcaccattgttgtcgttgcggtaccgaccatcgcctcggctttggcggtgagtccgagtcaggtgaacttgttgctgacggtttatctcaccacgatcagcgtttgcctgttgttctttggtcagttggctgatcaatatggccgaacgcggctgttcatctggggcacctatctgtttctgattggctctgggttggctggttttggcgttaactttcagttgatattggccgcccgagtagtgcaggcagtgggtgctagtatgaccatggccacgagttatgcgattgttgcggacgttttcccacccgccattttgggccgtgcgctgggcattgaatcgatcttcatttcagccggcgcattggctggccctggcatcggtggcctgatcctgagtcagttgccgtggggctatattttctgggtgaacttgccgattggtgtcgtgtgtttgttagtcgaatgggcggtttttccgcggacacatgcattctctggggaaaaaagcgtggatggccgcggctttctgcaattgattgtgattggcgggttgttgttgctcatccagatcaacaagcaaccgttgttcaccggaattctggtcattttgattggcagttgcgcctattggttttggcgtcatgagcggcagacgaaacaagcaatgcttgatacccggttgtttagcaatcagcgcttttcgcggaatttagcggcttcgtttttgaactatgttgcggcttatttttttacgctgctcgcaccgatttatctacagttgatgctacgcttgccagtggccttgtcaggctatttgttgatgctgacgccacttgtttcgttggctgccaatccagtggctggggtgcttagtgaccgctttgatcgccagcgactcatgcgaatcggcttgctgatgctggttttgacgaatgtggtctttgccttgctgcctcatcaaacgacaacttggccatttgttatcgtgtcagtcgcgtttgcggttggcacagcgctgttcacgaatcctaatagtgtcgtgttgatgcaaagtgtcgatgcgaccatgcgcggtcaggttggcgcggccacttcacttgctaggcagttggggatgagtatcggtagcgccattgctggtttggtgttctatcaaatcctcgggatcgtcagcccgcacaccaccgccgtccacgccgctccgcaagctctattcgttgcgcagggtgtcagcttcatgctcgcagctgctctgtttttcatcgccgtcatgttgttacgaaagaaggtagaaaatgccaaaagaaccggatgaattgctctcaagagtcaatatcctagcgcgccacattcaacacgacttggatgttgcgttagcgccaaccacgctcagtgcgagtaactattactttatcttgaagcttggcaaagtcgatgaaatgcggcaggaaacacttttcaaaacgattcaccttaatcccagcaacgtcacacgacgattggcccagctgattgcgttgggactcgtcgcaaaacgccgatccgacgaggacaaacgtgcttggattatcagcctcacgccaaaaggccggcgcctgatcccaatggtgacgcaaattgtggccgattatgaagccactttgacagcaaaactgtctgaagctaacaaaattgaatttgccaggatgcttgatgtgcttaacgaaactgaaaaggggtcggaattttgaaaaacgatatgctggctttattgccaattcccgaagactatcacgtggttcaaacagacgtccgcaagcgaaataaagtgcaagtgacggtagaccgctatcaaaacgttgatgaagtgacgccgaacaacaagcatctgacacttgtgactgatagaaacggcaacttgatcagttttaatgctagcaccttcaaaaatggcgggaaactgccgtcagctgataaagcattacggcaggcagtcacgttattcaatcagttagacccaaattatgcagatggtttaagctacatgcgaaccgagcagcaagaacgccattatgaagataacgggatgcaggttagcgcgccagtttactggatcaagtttgcccatcgcaacggttcctataactgggtcaccatcgggcccgacaaccagattattgaaattgagcgcgagtcgttttgggattacttcagaaatcgacgggcaaccgaaatgtggaactatgacaattgggttttggcgcgacaaggcaagatcccacaattagcagcacctgatgccttagcgtaaagaggtgaccgaatggcaaaagcagatttcgatacgcttgtgacgcaactgggcgacttgcgtgaacgtgcacggcgcctagcagacgaagattatattagtgccaagtacaagggctatagttccgaaggtttgacattggaagaagtcatgggggcgctggaagaaactgaaggcgaaattgagaaactggagcgtcagttagcacgatttgacgatgaatcatagtgctttgaaatgagaagatggtttgaaagggtaacttgaacattcggttttgcagaaaaacatgcagcgcaccaaggcttggcatagcagccagaccttggtgcgttttttggcatctgggagatcaatttgagaacctctttttgtcaatcagtttccggatcttagaatgtgtgtggtgattaaagatttgcagcaacctcttcaggcaagagagctagtgtcacaaaccgtttagtcttattagatatttcgagaaaataaatcggatttgattgaatgccattctttaaacaatattcctatatcattttttaaattttacagttcgttataataaataatatctgtttttcttgactttcctccatagataaagtacattagcgctaagctcatgactatattatctgattgccaccgttttcacaaaaacgaggaggatggactattgaaaagattagcaggaacagcctgctagacagcgccattctcataagcaatgaattttagaacacatctggcgggttcttatatccccaagatggtggtggttccttcacatgaagtgatcttccgggaccacaaacaactccgtatgatggtgatgcttatcaataccggttcgccggtccgcattgggcacaaactagtttttggattggatagttaaagcaacaatcgaatgaaacctaggtctatgagcttaagaaaaggcggatctgagcaaatccgcctttttgaatacttatcaatgagccaatatgtttgcaacttcgtaggtttgacttgaaagagaaaatgggtgacttttatgttgcaaaagctgagagactcgaattttgtcacgataattttggctgccaaagggacgcttctgatatgctgtctattgctcttctgctatttactattttcaactttgacaaatacgtttttaattcccacgaacgaccttttaggggatgtggcttcaattttaaaaggagaactctggcgcgttataacgagtactgtgtacttttctgaatggacgcctttaattaagacggttcttatagttttggctctttgcccgtttatagaatggaaaattggcagtcctgcgcttgttatgagcttttttgcttctagttggatcggcatcttgttattttgctttggacttggcggtatcattcggtcaacagttggcataaacacctacgtttatgctttttatggcggaacactgtcagtctatgctttatttccactggcagtattggcgttcttgataaagaaacctgccttttctttgttggcaaagtgcgttttagttggcggtcttttgttgtactttacagtggggttttggccgaattcagatacaccagagcctgcagtcattgtacagattagtcaattatgcggtgttctttccggccttttctgtgcccttatagtcgtggcgctaagaaattggaagaaagtttctttcttttctgccaaaccgagcaactgatcttataagacttaagaaaatttggtgctaatgatgctaatgaaaagaaaacgggtgaattttatgttgttaaagttgagaagacccaatcttttatccgtatttttgaatgctagaggaacattccttatctgctgcatattgatagtttgttatcttttgttttcgtttttaacgaatgttcttttaattccatcagctaactttgtcgggagcataccttcaattttaagaggggaactttggcgaattgtaacgagcacagtttaccactatgaatggccgcacttaatgaagaatatgcttgcagtgatggtgcttgggccatttattgagtggaaaattggcagtgcgccattcgtcattagtttttttgtttctagttggcttggtgtcttgctgttctgcttcgggttcggagggttcattcaatcagtgtttggaataggcacctatattgagtctttttacggtgtgtcattgtcagcctacgccttatttccactagctatattggcatttttaatcgaaaaacccacattttcctttatgacgaagattgttgcgtttacatcgactctttattacgtcacagtgggatattggccgaatccagacatgtcagatattgaaaaacttgttcaggttgcgcattcatgcggctttctagctggtcttttctgtgtatttgtcatcttggtaataaggaatcgggagaagatggtgtctttttcaagtcgatcaaaatgattgatcacgctgatgaagacgaatatgccgctatttgagtttgataattcggatcaaaattaatgagcgaaaacaacccaatttaatgcctggctttgcgcggcacctgttcgatcgagactctctcataatgtgtcacaccatagtgaacgttatacgtgagtcgcagcagttgtcctttggggaaggggccaggatcatattcgtcggttttaaacgcaaggaccttctctcggccagtggcatctttcgccgttgcccgatagcaatagcatttttgttgcaaattaaccggaacggtcacggagaatttactaagtggccggttaactttgatgtagtatgtggtgccgccatctctgtatgaagtccaccataaagtcagcccaacaacaatgagcaaagcacttataaatccgactttatagaggttctccactgttttggtagttagctttttcacgctaagcatttcccttctgctttaaaagtagccgccaaaatcattctagcagcagtgagtatttaacgtaatgatctgatgaaggcaccagaaaactgaatctcattttttgatcgcgctggtcatagttggctcggtttgttgaaaaatgcatcgtgaccggttgctctgctgccaaaagattttctgcatgcgcaatccgcttgttgtttttgtcaaagatagtatcagtttgattgctgatgccataaggaatattcaaccacacgttttccaagtaattaaagttattctttttttgaccgtagtttgcggatcctttttgttggatggaaattgtgacggggacggtgacttggtctttgtttttcaggacacgcgctttatttaccgtaaaatcaacatttttggcatgaacgagttgaccttctttaatgaagacttcatgagtgacccctttttgtttagtatttgcgttgacttggtggtaccgaaatgcaccaccaataccaatcaaagcaattaaaccgataatgataacccagattttggttttagatttcatgactaatcgtcccttctttgacaaatagcttatgggttgccacttgttcgacaaagtcatgatcatgcgaggcgatgatgaaagttgatccgttcgcattgtaggcctgaatcagttgaatcaatttaatgatgctgttatgatccagggcatttgtgggttcatccaagataatgagtggatagccgcctaaaaaagcttcagcgattcccagcttttgtttcatacctaatgaaaacttgcgaactttttgttctggaaacctcgtgagttcaaaataatctagtaggttatgaatctgctttggctgtaaagtcgtatccaatctggctaatagctctaagttcttataagcgctaaagtcatcaatgagactaggattttcaattaagataccagccttgatgggataggcttcttgaacgttgacggattttccggcaacggatacatcacccgtcaccgtcatgagtccaagtaacgcttttaaaattaacgtctttccagaaccattaataccttcaagggttgtaatgctgccacgctcaatctcagcgttcacctgatgtaagagctcacgatgtttaatgattttactgacttgatgtagttcgataaaagccataaaaaattctccttcagtttaagttgaggctacgttcgatgattaagtaacctagtcccgtcaaaatattgatactaagcaaaataagaatgggataccaagtacttgtctctgtgatgcgagtgagcatgagatagctcactggattgcgccgaaatgctgtatacgcagtcatgatgagagtgctggcaggaatgattaaagccaacggtgggttaaaacgattgccaatagcctgaagcaacaagagtaagaagacgcccagccacgtgatacaaaagagaccgccaaccgctaatgcgccattccaatttccaacgtgaagctctgcagaatgggcagtcatagcagtgatgagcatgacaattatcaataggacatcatagacggttgtgacgagggctattagtagcaaattgaccttagaaaatcttctgggggaaatttgaagtccccgtaagtgcagcgttcgagttcgccaaagttgttgaaaactattaaggagaattaacagcgggacaaagaagtaagcaaaccataatatgggcagcgtgacgcggtgggtttcaacggtggcgtaactgacgccatcaaaaaatagtgagaagacagttagatggggatttccggcaattcgcgtgctcaaaataatcaaacttataaagatgagccagaaaagaaagcgtgtccgaataatatgccagaaaaatagaaattggttgttaaacaatcgccacatcatatatccctcctgttgacgatgaacgtcattaagggaaccattaaaagcgcaatgcctagcatgatgatgcctttagaaatcagggcagcgtttgaatctagcgtggaaaaatcaaaaaataacgaaggtcgcctcgaaataacgaaagtgaaggacagactgttgatcccgaaactaataaagaatgcaattaatttactcttggttgcgattgcaagcatcacagtgatcaagccaagtagaaaaaccgcgatccataggtaaactgcgcgaatcaaaataggcaaccagaggtctcccaaaaaattcaaataaccgttgacagaaaggacgagaatattggcgaagccccaaatgatggccattggcagcattgtgaagcaaacgcgataaagcacttgaaggctaactatttttcgtgattgatatagcagaatatcttgtggacgtatttgaatcgcaggtagtaagcctaatagatacgttggtattaacccacaaaatatgagatggcgcggaaagattgtcgtcattagattttcgggtgaaaaatcagttgaactcatattgttgagaccagttaaactgatcatcagcgaaacaaaaccgcaaactagataaaccctgaagaaggctgtagttagcaggttttgttgtctgatcacattatgatacctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaatacatcgccgcgaccttaggccgctctcgtatttctattaggcatgagcttcaccgttgccctgaaggtgattactgcgccattatagctcaggatcatgccgatacttgtcggcatcgttgtggtcggcactcgattttaacgcctaagttgaagcggatggtaactgagaagctaaacctaggttggtcccctgaaatggtcggttatgccgttcactgtgcgccacacacgatttaccactggatttatcaaagacaagtcgattttcagccaagccaactctttgatcacggtaaacgtcataaaagaagacaagaccttcggtcgcgctataaccaagcagtaggcacctcaattgagattcgcagtgagtcagctaaccggcgaaccgaaaaaggacatttagagatggatacagttcgcggtggtcgcgggtcaaaggctgctgttttgaccattgtcgatcgggtgacacgtttaatggcgacaactaagcttgaaaacttatcacaaaatgctgttctcaagggatttgcaagactgatggtggactttccgggtccggttcgatcagtgacggttgatcacggtaaagagttttcctgcgatcaggcgcttacaaagcgctatcggataccggtttacttttgccacgcctatcacccgaatgaacggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctagggatacaagacgtttctccccaatctgagcaaggctgatgcagtaaatgatcatgagtaaggtcactatcccagttaccgtgaggttgatattcgcgtttggagataactcgtgcaagaaatcagccggtgagtaactcgccaaactagggagcgtcaaaaagctgttaagcattagaactaggatctgaacacatagtccggtactgagcgcaacaaaagagtttttgatccatacggaagtaaccatgacaaatacggagaaaagaccgccccatagactggcaaataagatcgatatagcagcatggaggagcggatgagcgtagtacaaaccgacaagcattgtattctgattgattaaaagaatattgctattcagtaaattatctggcctaatgtttgggaaaattgtgaagtaaaacaataaattaattagcaacgcaattgcgaggattgtgaaaccggaaagaaaagctataccaacataagaacggatcactttttgaaaaggagaatgcagtttaactttcgctaataaaccggagtcagcgtcgttttttagtagcgatccagctgggatactggcaatcaaaggtaacaaaatgaagaaaaggatcggagtaaagttaaaaggatcaatcgataaccagcgggtataaggagattcgcccacaggaatgaaattcaatatctgggtcatctgtaaacaactgatggctaatgcaattgacaccgcaagccatagccgctttttgggtagccgtaacgataaaaatgacaacatcaaaacacctcgctcaaaattaaatagcatccttatgaattggatcatacagtttttaagccttaaacgtcaacttatttttatagataccattagttattaattatttttatgagggggaagcttgataagatcgtggcaatcaatctaggtgaaagagtaatcaaatatcatttcgggtattgatggtcggcttgtgttcctaaggcggaatttatgtcaaaggttaagattaaggcaacattgtcataccacgctcaaccaataaggaaaagctgatacgatcatagcaatcaatttaggtgaaagggtgatcaaaatgagtttctcgctattgatgctgttgtttttcctagttggtatctcggtattcctggtagtcttaaagcaaagcatcgcggctggacgtggttaggccttggtctgtctgtcctagcagcaattatgtttgtagcggttgtcttccttcgttcctgcttctaaactcgctttcttgcaaaacgattaacgtttatatcatcaaactcaaggttaagttgagatggtttcgctactttgttaatctattcacgtagacaacaacataagggagggaccatgttttgaaaaagtgggttaaaatcgcagggctgttggcactgatgagtgtcgtgctggttggttgcagtagcggggcgagttcaaagtcgagttcgtcaagctcaaaagcgaacaaagtagctagcagcaaggtcactagtggggcttcacagcaggcctacacagatccgaagacgatgaagggcaagtatgacatcgtgattgtcggtgctggtggtgccgggatgacggctgccatcgaggcgaagcagcaagggatgaatcccgtcattcttgaaaaaatgcccgttgctggggggaatacgctgaaagcctctagcggtatgaatgccagtcagacaaaggttgaagctgcccaaggggttaaggacagcaatgatcagttctatgaagaaacgctaaaaggtggcggcggaacgaatgataaagcgctgctgcgctattttgtcgacaactcagccagcgccattgattggctcgactcgattgggattaagctggacaaactgacgatttccggtgggatgtcggtcaagcgcacgcatcggccacacgatggttcagcggttggcggttatctcgttgatgggctcgtgaaagaagtcaaaaaagaaaagattccgctgtttgtgaactcggatgttaccaagttgaatgaaacagatggtaaaatcagcggggtcaccgtcaagatcaatcaagacaagacgaaaaaaatcgcagccaaggccgtgattgtgaccactggcggtttcggggcaagtaagcaaatgatcaagaaatatcgccctgatctggctcattacgtcaccactaaccaagctggcgcaaccggtgatggcatcaagatgatcgagaaagtcggcggctatgcgatcgacatgaataagatccaaattcatccaaccgttaaccaaagcaagcatattctcattggggaagcgactcgcggtgaaggcggcattttagttaaccaaagcgggaagcggttctataacgaaatgaatacccgtgacaaggtttccgctgccattaacaagcaaaaaggtaaggatgcttgggttgtgattgatacaggcgtccgccaacggtcgagtgccattgacttttatatcaaggataagctcggtgtcgaaggcaaaacccttgatgaactcgccaagaaaatgaaggtgccagcggccacgttatccaagacggtttcaacttggaacgaagcggtcaccaacaaaaaggatgccgagtttggtcggacaactgggatggaccatggcctcaccaccggtccttactatgctttcaaaatcgccccaggcatccattacaccatgggcggcgtgaagatcaacaccaagactgaggtgctgacaaagaagcaacaaccaatcccagcactatacgcagccggtgaagtcaccggcggcctacacggcgacaaccgaatcggtggcaattccgtcgccgacattgtgatctttggtcgccaagcaggaacgcaggcggcggcttacgtgaaagcacaacagtaacctgaatgacttaaaggcggttctcgtcagatgagaatcgcttttttgatgcgctgaaaatggcggtgtccgctcaacccccaaaattcatatgctccataattgttaggcaggcaagcctagccgttatggggctttttgtcacttaccgaggccgaaacttgaagaatgatgagcaaggtgtacttcgtttcccaagttaaggaaaaaggttctacttttcagtatgtaagcgcttgcttagtatagaagctgtaaggaggcaaagcaatgcgagaaagattgacgaatcttctgcgaacattgttggacagttcggcaagttctttatctgatttaggcaagcaattcaacgtcacgacaaagacgattcgaaatgagattcaggttttaaatgaagttttggcggagaaaaacttacccttattcgatatcaaaagaggtgtcgcctacaatcatatctcaacgcaacagcggcattcgctgtctgacgtccttgattttgacagcatcagtcaaggcgctttaacccctgagcaacgtgctgtgtatctcttattggatttgcttcaagccacccaaccggtttatctcgtcgatgaacaagaaaagatgcagattagtaaaagctcaatggattctgatctccgcaacttgcgggctgatctagcaaaatacaatctaacactcacgaccagcccaaagttaggcgcacagattgaaggcaacgagcgatcaattcgaacgatgtttggggatgtcctaacacggcaacatgctttggtcaccttgattgcccagcaattaatcgccagcgggatgtatgtcgacaagatgaaggaagtctttaccaaacaagatgtgacctatatccgggacttactacgccgttgttttccaaaaggggccttggccgccaacgacatgtacagccagcaagtgaccgtgttactcattatctggttacaccgtgttcgcagcgggcactatgtcaaagatgatgaaactgccgttgatctcaataaggaaaatgccaagtttctcaatgaactcattcagcattatgccttacaaattgatgtcgccagcgagttaggttatgtcggttttctgatcaacagttttaatcgtcgcggtgcgattgatcttgacgactgggtcaaggcccagattttcagcgttgcgctcattgatcatatggaaactgaaattggctttccattttctaaaaacgaaaagcttttcgaagagctatataaccatatgaccgctttgttcaagcgcttgtcacagcacgtcaaagtggttaatccgttgagaaagacgatccagcaaggctatgggccgatctatgacgcgattgatcgtttcttcaagacgggacgctatcagctgaccatgtctgatgatgagaaggcatttctggcgatgtatttctcagcgacacaagctgaggatcgccagcgccaagactatcagtatcaagccgcagttgtctgcaacttcggcacggcgacgggcagagtgttggcagccaaactggaggaacggtttaacattgatgttcttgccgttttgagcacgtctgaagttggcattctccgcaaattaccggtcagcttagttttcaaaacagtcgacatgccaatcgataaaatcccgagtttgaaggttaatcccattccttcagaagttgatttgacccgagttgccgcgtttttgaagaaacacacaacgttaactaagtacgaaggccgtacgttagatccaacaagactatttcgcacagttctggatgtgctgaaaacccatcaggtgacagttgataaacgactattagctgatctgcaagcagcattcaaggagaaccatgtcgaaattaatgaaagggaggttcagcctatgttgaaagatttaatcaacgatcaccagatccagcttcaacagaaagctgatgattgggaagatgcgatccgtatttcagcaaaaccattgcttgacgaggattacattaccaaaaattatatccaagcgatgattgattcagttaagaaattcggtccgtatattgtcattggacctgccatcgcgctagcccatgcacggccagaggatgggacaaagaagcttggcgtgacgatcacaacgttggcgaaaccaatcaactttggcaatccagacaatgatcccgtgaagatcatcttctgtctggccgcggtcgataattattcgcatctcaatgtcatgaaagccattgtccaactcatcaatgatcagcaaaaagttgatcagctggcgcaacaaacagatattcaaacctttaaaaacattttattcaacgagaaaacgtcaaaggagacgatttaaatgaccaggaaattaacgatttacttcatctgtggtgccggcctaggatcctccttagcttgccagatgaccgcagaagacgttttgaaccgtttgggattagatgaaaaccttgaacatgaggcgatttcatcaacaccaggtttacggacggacatcattgtctcggcagaaaattttgcttcgcagttcaaacaatatgacctcgatccagccatcaagtttgtctttctgcacaacattgttgatccagacgaaatcgaagccaagctcgtgccagttattaaagaattgtcggaaaaatcagcctgaacaacagagcgtgagctggcgtggttagagaccggagtataagcggccttgaatgtgatggtcgggctttggccattgcacccaaggtccctatgtggcggtttccgcgccagtgatcgcgtttaaaagggggaatcaatcatggttgtggttaactttattattcaaaatattctgactcaggcagccatcaccattgcgttaatcgcaatgctgggcttgcttctacaacgcaagtcctttggcgcggtcctaactggaaccttcaagacactgctgggatttcaagtattatcagcagggtccgccattattgtcacagcactgacgtatttcggaaagatttttcaacatggttttcacctaaaaggggttgtacccagcattgaggcgatcaatggtcaagccatgaatacgctggggttgggaaatgaaattgccttaacctttttgggcattttcattgtcaacattatcattgcgcggttctcgccatggaaatatattttcctaaccggacaggcgctgttgtggatgtcgaccatgacggttgtcggcggcaagatagctggcttcaattcagtcgtgaccattcttgttggtagtgttatcgggggaattttcgcggtggccatgccagccattgcgcagccttttgttcgtaagattaccaagggcgatgccattgctttaggacacttttgtacgatcggctacatggtagaagcaggcgccgcttggatcttcggtgaacgtggcgaaaagaaacactcgattgaagacatcaagttaccaaagtacatggaattcttgcaagacacatatctctctgttgctgttgtgatggtgccattgtttatgatcaccgcggcttttgcaggtcctaagtacgccggtaacggcacgagtctgaactatatcatgaatgctttcatgatgggcattcagtttgttgtcggggtctatgtcctacttgcaggtgttcggctcttacttggtgaaatcgttccggctttccgtggtattgcgatgaaactggtaccaaatgcgaaaccagcacttgactgtccagtcttgttcccattctcaccaaacgcggtcatcttaggtttcattacgacaaccattgggaccgtcattggcatgttcttgatgcctgttttcggactcgctgtcattctgccggggatgttaactaacttcttcgctggcgggactgcagggatcttcggaaacgttgtcggcggccgccgcggggccatcattggcggcattatccacggcctgttcatcaccttgttgccagcgctgctagtcacggccttgacctcgtttggcttcgtgaatgcttcggcaactgactccgatacgatcgtggccatgctgatgtatgcctggatcctaacgccgattcttaaagcagtttaaagaaaggggcacgactatgtttggcagtttatttaaaaagaaagacacgcagaaacaaccatccgcggtgccaaaagaagtcaatcaatcactttcgacaaccgaagctgctgctctaaccaaaaaagtggcggcattgacgactcaaattgaacagataaccgatgataaagacaaacgccacctgctatacaaccaattaggcgctactcaggttaaattaggcaacgacttagaggcaatcgcagcttatgaagcgagtgtcaaagataaagaagagtttggggatgcatacaatgccttgctgaacctatacgagacgcagcgaaaacaagcggcaaaagcgaaaaatgatgacgacattcaaaaatgggtcacaaaaacggatgcattgctcgatatgtccaaacgggtcatgcggtcaggttttggttattaatctgctgggaggcaatctactatgtacaagaacttaaagcaattgatggatgaagcgcaagcacttgattatacagttggcgcctttaatgcgcacaacttggaaatggtgccatcaatgatcacggctgcaaaggatgcaggatcgccaattatcattcaaacaagtgttgcgacggctgaatacgttggcatgaagaactttgttgcggtttgcaaatccatggcacaagatctgttagtcgatgttgatctgcatttagatcacgctaagtcatttgatgccattaaagaagccattgatgctggctattcctctgtgatgtttgacggttcagcgctgccgaataaggaaaacatggaacgggcacgccgggtagccgactatgcacatgaacatggtgtttcagtcgagtgcgaaatcggcacaatcggtgggactgaagaaggtgtgaccgtcaaggaaggccggtatactgacccgcaacaagccattgccttcttgaataacgtagatgtcgaagcactagctgtcggcgttggtactcaccacggccaattcaaatcaaagaccgaattgaactggcctttgattgaagaattgcacaaagaaatcagcaaaccaatggtcattcacggcggtaccggcgtgaacgaagctgattatcatcgtttgaccgaaaacggcttccgcaagttcaatgttggaaccgaattattagttggttggacccggaaagccaaagaaatgttcggtcagaccgaggtcaacaactcgctgcggaacaacatcgaaccatgcaaccaagttgtctacgatatcgtcaagcacaagagtggtttgttcttaaataaagatgccgaagtgccaattaacgcgtaagtggggaagagcgtaacccggctagaagtcgacgtgtgactgtgatgaattgcgatcaaggtccttaaacgaagacttccgagctagggagcccgtctagaggagaggatgacatgatgagcgatcaaaagcagatcttggtcctgctagcaggtgcgccaggcacaggcaaaacgtatactgcaaataagatcatgcaagcaatcagcggattcgtctccctgccgctcgatctttttaaagaacatctttacgatgagttaggctttgataatcttgaggaaaagcaactcctcgatgcagaagcgagagcacgatactaccgcggcattggcatgctgatgcaggaacacaaaatgattctgggcgactatcccttcagccgattgcaaaaaccagcgctcgaaaaattggcagccaaacatcactatgcggttatcaccatcagattagaagcagacatcaaggtactctatgatcgccagcgaaaacgcgacctatccgatccccgtcatcttggtcatctcatgaatcactatcatcgcggtgatacactcgaaaacatcagcgaaacgcctgatggcatgccgacatttgaagtgtttagcaatcgcgtgcaagatcgaggctaccagacgtttcagctaggtcagttgattcgggtggatgtgagtgattatggggcagtggattatcgggggttggtggaggcgttgagagaagcgattagaggcgttgaactgtcaacccgatagtgaaattagttatcaagatttgtgacttttaataatagtttgcaaataaccttgtcctgagctttggaaacaaggttatttttgtggggatttttgtaattgtaacgaagtgcacaaaagagaatgctagacttgtttaaatagaaagctgtttatcaagagttttgggaaaaaaggctcaactttatttaaaaataatcttgactagtgaataaattcacttatagtagttactgttggtagctaccattttgagactttcatttctgaggggagatgatgaattgtggatcctgaactaacagacttgttcaagcagtttcatttttctaagtacgagagtcagtgttacgtcacgatgcttcaattaccagcgagtaccgggtacgaaatcgcaaaacgatcaggtattccgcggtcaaaaatctatgaagttctgaatcgtatgacggaacgtggcattgttttggcaagcaagagtgatccaacgtattacaacgttatctctgctgatgaattagtgacaacactcggacaccaagcttctgcccagttggcacgaataaaaacacgattagcgaatgtggagactaaacaagatggtgaactgatttattcaattcccaacagaaaacagacacaggacaaactgtcagacttattggcgcattgcgagaagtcgctttacttacaaatctggaaagaagatatcagttcggacattttaggagaactaacacgactttctaagattcttgatcatttcgttgtcattctgtttagtaatcgtcatgactatcacatgccttttacacgagtatatccgcactggtttgaacgtgataaactactggacttcggcggccgttgggttaatgccgtcattgatggtgctgaggttctttatggcactttcggggatgaaggtgatgatgtcatctatacgagaaatcattcgtttgttttcattgcgcaagaatatgtgattcacgatgcgtatgatctgagaacgctggaaactttagatgcagcagcaaagaaggcgtttggtccggatctcgaaggcgtcagagatatttatatgatggatagaaaagggaagaatgctcatgattaagatcttattgggattaatcgtactaattaatttaggctttgtattttactttatccgtgacttgctccggcatcgttcagaggttatgtcggaacctgcaacgacatgggcattgccatttagctcatttattattttcttactttcaacttttggcatttctgattttgctatcagcacggcactttaccctaaggctaaatgggtttcaattaagaaactgccaggcaccttaaacacgcaatgtgttgtccccgttgctgcaatggcactttcttacatcaccgccattactgtcgatattaaaacgctagctgtatgtatcatcgcggcagtcattggtgcttacatcggacctaggtttgttgttaaactgccagctaacacaattaagaagtttgtgacagcaggtctgattattgccgcgttaatgattttagcgggtaagttcaattggattcctgctaacggaacagcaacgagcttatctggctggaaattaatgctaactgcaatcctgctgttcatttatggtgctcttaacaacatcggtattggttcctatgctttgacgatggccacggtttatgcgatggggctcaatccatcagctgcttttccaatcatgatgggagccgcaacattctcagtttcaacgagttcgattcaattcgttaagttggctgattatagtcggaaaatcacattattcacttcaacttttggtgtgctgggtgtcttagttgccgtctttttcgttaaaagcttagatactagtatgttacagtggctggttatcattgtgctactttattccgcaatcagcatggcattgtccttgcgtcaaaagggagaagcatagcattgctgtttcaggttcaacaattataggaggattatgatgcgcgttttaacgaaaaaagatgttcaagcagtttactcaatgaaagatgcaatcgctgatgataagattgcactggcagcctattcaaagggtgatgccaccgttccattgagaacgaatattgatatcaaacctgataatgggcaaagtctttacatgcctggttatgcagccgttaaagaaccagcattaggtgtgaagatcgtatccgtttaccctaataacattgataagggtcttcctagcgttcccgcaacaatggttagtctgaacccaaagactggtattgtgtcagcaattattgacggtacttaccttactcagcttcgaacaggtgcgcttcaaggtgcagccactgatttgatggctaaccctgatgcaaaagtggcaacgctcatcggtactggcggtcaggcaccaacacaactagaggccatgctaaacgttcgtcaattgacgcgtgtttacgtttcagatattgataaagatcgtgctgcaaagtttgcacaggacatgacaagacgctttggtaagcaatttaaggttgaaattctcccagcagttgacttacaaaaggctattcgagcatctgatatcatcacatcggtcacaacatcaaaacaggcgacttttgatgctgccgatgttaaaccgggagcacatatcaacggtatcggcgcatacactccgcaaatgcatgagatccccgcagaactagttaaacaggcagatattgttatctttgatacgatggatggcgtattagccgaagcgggagatatgatcagtccactgaagaatgggctggtttcaaaagatcagtattcaggtgagttaggacaacttattaatggcgatattaaaggccgagatagccatgaccaaatcacattgttcaaggccgttggcaccgccgttttagatgtcgttgttgctgaaaaaattttacaagcggcggtgaaagcagacaaagggactacgattgatctgtagtagcctgaaggattaaatgttggtcggcattatttaaaactgcaaagctgaatagagactacgtaaaaggcgtcttgattgagagtgaaaattcttaatcaagacgcctttcttaagttgcaggagatttatcacgtgagacatagggtcttcaaaggtcacttaaagctgtcccgcaaagcgcattaacggcgttagttatttgatcctttcttggcattaatcgttgcaccttaaccagtcatagtaggtactgcgggggatatggaacactttgagaacgatgtgcatgatacaggtgatcctgccagagttcaattcctacagatagcattaatgttaataaatagctttgatgtatataaatagaattaatagtatatttgttattgaaatgacgaaagtaagatggaaagtctatatcaaaaattgctgatgctatgtttataatataatttttgtttaatattttttgttaatgacggttattcgtgcatactgtaaaccaaatgatataatgacaatgtttggtcaataactaaggaggcagttttatgtctgaatatattactgtaaaagacggaactaggatatcatatgatgttcatggagaaggaagcccaatacttctaattcacggtgttactgactgtaaagagacttatgatacggatttgccgtttctaactaaaaatcaccgtgtttatcgttatgaccttcgaggccatggagcttcagatcatccaaagcatccatttaccctagagaaccatatcgaagatgcattagcagtcatctcaaaactgaatttgcacaattttgtcttgtacggtggctccttgggaagctacatagcagaagcagttgcaaccaaaattccacaagatttaagtggcttgattttaaatgtctccgctgcgcataatccagcatcagctcttgctgacacggcaaagaatgacaatatccccttagacaaagttgaaaggagagattattggattcgccacttaaccattgataaggataatatcaagccctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccgttcattcgggtgataggcgtggcaaaagtaaaccggtatccgatagcgctttgtaagcgcctgatcgcaggaaaactctttaccgtgatcaaccgtcactgatcgaaccggacccggaaagtccaccatcagtcttgcaaatcccttgagaacagcattttgtgataagttttcaagcttagttgtcgccattaaacgtgtcacccgatcgacaatggtcaaaacagcagcctttgacccgcgaccaccgcgaactgtatccatctctaaatgtcctttttcggttcgccggttagctgactcactgcgaatctcaattgaggtgcctactgcttggttatagcgcgaccgaaggtcttgtcttcttttatgacgtttaccgtgatcaaagagttggcttggctgaaaatcgacttgtctttgataaatccagtggtaaatcgtgtgtggcgcacagtgaacggcataaccgaccatttcaggggaccaacctaggtttagcttctcagttaccatccgcttcaacttaggcgttaaaatcgagtgccgaccacaacgatgccgacaagtatcggcatgatcctgagctataatggcgcagtaatcaccttcagggcaacggtgaagctcatgcctaatagaaatacgagagcggcctaaggtcgcggcgatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggagcaactaacagattcaggatttcaaaaaaacagcttgtctcctgaggatgaagatagagcgctaagatctataacggcatttgattttagaaatgaattgccaaaaatcacatgtccgaccttgattacgagtggtttgtatgatcccgtcaatgggccatcaaagggaattgagattcagaagtatattccgaatgcttgctttgtggtctttaaatcaggacatcttcaacgacttgagatgccaacagcctaccaccatgttgttgatgattttatcgaaacagtcgctcgctaaaatggcaatagcgtcaggtatcatcaactcaacaagaaccaacacatttgctagttttaaaagtgagtatgcgtctgctgaccaataatggaaaacgtaacacatgcttgagaggataacgtaaaagcgagtgccaaagtcctttaggaattggtcaacacgttgtcacttttttatccctctatctaggagctttgactaccttgaaatcgaggcttttgtgttgcatcaagggtgtagcggatagcatagtgcagaagggcgggcaaaatggccttagcgatttttaacttattgtcaataattttgatattcatcatcatttggcttacacgcaaagaaaaagtcgcaacgcgagcgggacgatataaccgagccttcttgattattattgcggtcatagagattgttttaattatttcggaaacatttattttcaaggattcaatttcacttcaatctgcatcattttcttgtagcttgttacttctgataaacctgttacttagctatagaatgcattaagcagcaaataagtgccatcacttttcaatctcatggaaagtgatggcactttttaaatggcgcacaaatgatggtaaagaaaacaatcaacgctatccactcgacgtaacgacggaagaaaaacggcagcttaaagcactttgtcgcattgtcaaggaatgaccttcaatatggttgcaacacttgatggtttccagaagggtattagatcggataaaaggctaaaacatgtcgaatctcctttttagccaacttaaaacaaaaattgtttcatgccttagtgatgaagatcggccaaggactgcttaagctctgctaggtatcgaacggctgtatttgttttaaatatctctaatctgttaattatcgtacaaactaattatgtcagaaactacagcgtaggagccgactttctactgaatttaaacaggctccgaatttttgaattgattttggtgaaatccaagtaattaattttttgatttgctataaagttaaatttttcagcaatctgggggctgcttaatgcctcagcacccgattaagccaaaatatcgaaaaaaattttcgattttttgacatttcaattgtggcttttgtgctattatcatgttgctttatgttgcctgcttatttatttattaacataaagtgcctatcaccagacaaataagcaagacaaccaagtatattaatttaaatttaaggaaactaacatatgatctttgatactaaacaacactacaagaggtgaggagtaaatgtttcaatatgatcctacactgtccgttctttaaatatcggataattgcctttgttcgtcatgagtatcgaaacaatgggccgtatcgctgcaagtatcatttgatagatgccaactacctatcgattcacctagtgttcacttgaggttttgaggcacgatacgttattggggttgacacaacccatgcgcgtgtcttcaacgaagtcgaggtactaccagtcgtggtcccggtgacgttattgcgacttttgtcacatggtcggtgccaagacgccgctcttgcaacacgatcacacgcttgctaattacataaaggccccgatcatgaaattggttttgagcgactaccagtcaaaacaattatccgcattgtcgggatttcagtttccttgattcaactgtttatcgaccaaaatctcaaatttcgaccggtccgacgactacctacgcgccgctgttttgacgaattccgttccactcacggcatcaatcttgtttatctctctttgctggttcacatatattggcgccttgcttggtgatcagatcaactgcatgattaaaaatttcttcatcgcctattattctctggctgaacgccctcaggttccgactgtccccatggatatgaatgcaggttatcaggcaaatattcatgagggtttcacccaagttcaagcaaacatatgagacctatttagcgcttcatgatgctctgatggtgaggaaacatcccgcaaacctggccaacctgttagctacttgcgagccaaacggtgcggcaatagacatgacgatcgcaacacttaagcgacacaaagtcgctgttctcaatgccatcaccagccctattccaacggtccgatcgaagggattaaccgcctcatcgagtcactcaaacgatcctgttttggcttcaaaaatcagcagaacttcttcaaaaaaatcacagcataacacgacaaagacggctccccaaatggagaaccgcctcaaatgataaatttattcttcaacatcagtcgacgtagagccaaaattcgaagcatgtccgttacttataaaaagtataacaaatttacttgcaaacgaatgcttaatgagatgaaatggtgcttgtatcaagtcgaacttttgaagatcttcccgcttaattggctgaatttggtttgagacacttatgcaatttgaatgccagcttctaaggtattatccaatttatagattcgttcaacatcaatgaccaccacgccagcgcgtgggaaacgatcaaagatgttagttttatctagaatctgattagcaaagtcatctgcttcatgaatatgagccgttccctcaaagcgaaatcccttttgagcgcctctatcagcaaccgcaaccgccgccaaatggttgttcgagagattattataggcctgcctaaaggtgtgctcaaagtagattaaatgtgagtcatctaagacatgtagtgaacccttgggaccaacttgaggtttgccatcttttcctgttgttgctagaaaggggagctgattcttcaacatatttttcatttcttctgtaaggtttaccatttgattttctcctatcaacgtaatactggctatttatttacttttagtaaatatattgttgagatactattttgtcaatcctatgtcccaagatgaacatcgcagactaggatcacggaaggtttaaaaagattcccttgttttgtaaattggttaagcaaacatgtttatatcgttggtcatgctcaggatagatgggtattgtgagtgcaaccggattgagttgtttgtatgctgggcaatgttgacctcgatacagaggatcataccatttctgatctggatgataacctcgtttttccatttcacgtaacacaatacagtgaaattgaaataatttatatggggaatgtgcaaatacgtaattaacggtagcgtgtttccgtccccatccattaccgcgaagcgccgcaatttcacgatgctgtcccaataattgttgccttgggagttgctgaattaaatcttgatgccataaacgcacgttacggcttcctttcttgaaaactagtcttaatatttatgccatttggaggattacagtactgaaccattttatgacgaagcgccttttctataggttcatcggcagtataagcaatgggattcgctccaactcggactgtctgatcaatttgttcaattttgttggtgtgattgattatattgctcttgcaaaggaatgatatccttttttgttgtctttggagcagcgattgcaccctccgcatgaacatatacacggtttatataagatggctttgaaagtgaagccgtgctacctaattttgaatcgttttatcctaactaatacctatcacgccgaatttgttattagatcggttaagcatagaagaaactaaaatattcaataaattattcgaaaaatttcggaattaacaatatactttttagtccgtttattagctttttatgattgatctacttttttatgactgcaagcacccacaaatgcgcgtgatttccttttgaggtcggtgaccgtcaacaatacatttggtttcacattggctttaacacagccaaagcgtgttaccgttggaattgcttcctcgaaaaattaatagctgtgagtcgcccaaacggttgattgactaaattgatacgcctttgcatactaatttttgcttgatgaggaggcatttaaagagttactttcaattggtcaaacctcagttgacaccatgaaataaaggctagtccgtcaatcgttcgaatgccttaaattctagtatacgtcaatttttgagtggttagtagttgatcgtatagtttactaatgatagcccaatcacaattatatcgatgcttttgtcgagcccatgcacagtttttgcttctaggatagttgttaattaatatgcctgtaaacgacaacaagatcgtaagtgcggtaaaggcaattcgctttcttcttgtttaagatggcgacaggcctctttataaatataggttttttgaagattagctgaaagagacccatattcaaaaacgttgtcctgatattctcatgtttggcaatttcaatactttgttgttgtggcatctttatgggttcgcgattttcttgagcaatatatttagtggctgcttaaaaattctataattcaggcagttaagctaatatatgcattattgcggtataataaatccattggaattagctgttttcctgcattttccttgcattttttgggaacctactcggaggttatcgtatggtctatcgtcacagcccgcttcaattgtcatttgaatcctttggtgccggtttaagtaccccacttagctctaacaatgagtggatccagttggcggaggtcatgccctggaaagctctcgatgaggcataccaattggagttcaccaaaaatgcgggacgtgcggcaaaaccatttcgtttactctatggggcaatcctgatccaacaacggatgggtttaactgatcgtggggtggttgcggcaattcgtgatacacccgcacttcaatatttcatcgggttgtccgaatacaaagcggttgagccgttcaattattccagcctggcacactttcgcaaacgaattgccgatatctccgagctgattacgaatatcatgaatgatacagtacgcgccaagatcgaagcgttggtcccattcaaagtggacaccgtcatcacggacgcaaccgcagtgccagtcaaaatcaagtatcctcaagacaccgtcctcctcaaccaagcaaggctgaatcttgaggcgatggcgatcgatatggcacaccaacttggtgtgccaaacccacgcatgtacaaacgcgaggcgaagcattgttggacctcattttcacgacatccaaagcaacagcgtggtggctttcataaacaggtcaaggcccaacttcaatatgtgcgccgtgatttgcggtacatcaacgaattcatcgatcagggtgcgactctaccagatgaacaagcgattcgcttaggcgtgattcgaattctatttgaccagcaatggtacatgtatacccacaagactcaccacgttgaagaccgaattgttagtctccaacagccgtacattcgcccaattcaacgtggtaaggccaatgctaaagttgaatttggggcgaagattgactgttcgttaagtgaaggcgtagtcgacattgaacgttttgatttcaccgcattctctgagggccaagacttcgcggaaactttagaccactattacgaccttcatggacattatccggatgaagtactggccgatacgctgtaccgtaatcgggagaacctaaagctgtgtaaggatttgggtatccgaatctgcggtccgaagcttggccggcatccaaaacacgttgatgcagcgaaacggcgtgaggatactgatgccgagaatcgaagaggtaccattgaacgccggtttgcttttatgaagggcacgctggggcttgacttggtgaacactcggacagctgaatcactggccgtcaagattgacgcggccatcgtcttgagcaatgtgctgaccctgttaagggtatttgctataccaattttaattttggctaaattcgagggtgaggcctatcaaattcgctataaatttactacaagggtcgaagatatggcggcctagttcaacagccactatttatataaatcgacaatgattgctgtgatcaaattatgaaaattaaggccttcaaagctgggtagacttagaaccttcaattgaacttcacgataccgaatggcctcaatgatattagtcaaatcatgagaattgcgaccagccgatcaatcctcaatactaccacttcatcatcacgaatatagtctagcacacatagaattcgccaattgagcctccgaatacttaataatgcctatataagttaggtttctgaatttgatgccaagaggccacaatcgttctaacaccagcgccaaaatctgattatgaaaagataatataaatattataatatttaaagagtatttcgaaattaatattcacttattcttctaaatatcgacggctttttttcatattttgacagaataatttactggtagtcggttctgaacgtatatgatcatcacgcaacgaattgctagaatacgaaaaagctgatatccatcaaccgaataatggcacttaaaattcataggattaacattattcgctttattctaacggttagctaaaggacggctccaaaataagaaaagaaatatcggtatacataatatgtactgttttattgtagtactattgggattatctcaaaagtatgacgggtgtaatccataatttgttcagaaattccttttctactgtatttagacttaatgatttttaaagaagcaaaaatctataactttaatttatctaactagttacattgtgaacagataagaaaaacggattttttactttttattaaagcggagaaacaatctatgcgaaagcaattaagacaaaaaaaagtaaagcttcgatggaaccgaatcatatcctttgcttctgcctgcatattgatattgagtatgttaattggcttgacaattagtgtgttaaacgacaccacgagaaatacttcagcggcgtctaagccaagcgacaataatcctgtgtctgatactcagacaaaaataaaaaacaatttgactcgctatttggcttcggtgacctctaatggaaacgtggcagttgatttctacaatttaagtccggttagcggcagtcaagcggcccaagaaagcaacgctgctgtgtacaccgaaggcagccttgctgtttcatttaacgggacccaacgaatgattgcagcttcgacttataaattatatattaccgcgtggctgtttcatgaaatcgaagttggagcgattacttggaccgataatgatgaagacggtttccagcgtatgattattaactcggataatgactactcagaggctattcttgatcaatatggcgctaaggtcttgaataagtactatgcaacgctcggaacaggatatgtttttaagagtagcggggcgactaccaccagcaatgatttaatgacaatattgaaggcaattcaaaaagggactggtccatttgataatgcatcccttcgtaaaaagctgttgaccgcaatggaaaatcaagtttatcgagacggtattccggctgctgccgaacaagttgctagcggatcaacagtgcaggacaaggttgggtggattggcagtactgataatgatgctggtattgtgacaacacctaagggcgatcgttatcttttggtgattatgaccgataatggagactatcaagacttttcacaaatcgaaaaaatcgcctccaaaattcaaaccatagtgtatggtaaacagtaatgtttttacatgcgctcttaatgcacgatttcctgtgaacttgtgctgagaaattgtctttttcttttgcgaggccgcggcctataaacagtccgtttattgatactgtccttgtcttgcttctatcattatgtcttgatcattaacgtcaacattgccagcaaaattgggagtgactaaggaataggagccgatacggtttttgaaaatatagtacccgccagagaaccttgcatcatttgaggcaaaatcaagctctgtatttacttgaacggaacgaattggtgggtcattcttgaaatgaacatccggtgcagaaaagatacgcacagttttcattgggatgacttttttagtaaatgacccagttgctgtacggattacaccattatgagactcgttccaactatataccgagaatcttgacagattagcgtctagagcgatgtgcgaaggaacgttgacgccattgaaatgaaagtttggcggcgtcccaatggcatgaagatcaattccttgagtcgttttctgagtgttttcgttattggcctgtgattctgattccacactagacactatcgcagcttgcggttttgaaatagaatctgctcgtgctttagatgcatctttggttttttttttagacgctgctgctagtttagctttagacgaatgttcagattcagttttcgtttggtgtttggaacttgtctcttgcttgggactattatccgcggagttactttgacaccccacaaggccgagcacaaccaacatagcagaacaaatccccaatgttcttttcattttgatacctccttatatggctaggtattatcacatttcaatactcataaatccttataaaggtacacttgattcttcaaacatcacttaaagctatcacgcaaaatcaactcattacttgtaattagtttgacaggtttggagatagtgccgtcaataataccttgaagcaacatgacacttgttgctcccatttgtcgggttgctaagcggattgtgctcaggcttggcgttatatagtggctaacgtctagatcaccaaatccaataataccaacacgctctggtatagcaatattgttttcttgcagtgctttaatggcaccaatcgccatcgtgtcactttcaacaaagaaggccgtgggaagttcatcgcccaacttcgatattgcgtctttcatttgcttatagccactttcaatgctgaaatcgccagcgaggacggtggagtcagcgctatttttgtgtcttgccataaaattcttaaaggcgacggtccgcggatcttctagtccgcggtcttttgttgaagagccggctagtagtccaatatgagtgtgtccatgtgcaagaaaataggtcaaaatttcttcaactgaatttgtgtagtccgcagtcacgcaactaataccgtgtttaagtgtgtcttgattaataatgacaagcggtttatctagttcggataattcttgtaaatcctcttctgaaaatcgaccaattgcaatgacaccgatgatctttgaagattcgggcagttcttcattaaaataatggcggctaacttgataaccacgactttttagggctaattcaacaccccaacgaatggcacgaaaatagagatcggtcatgccgacttcttttgtgtaccaatctgtaatagcaactgtcccaacggtatcttcaggtttaggtggctgaattttataattcatggattgcgcagttgccataatgcgctcacgcgtttcagggctgacagacaaagttttatcaccgctcaaaacacgcgaaacagtcgcacctgaaacaccagcagcttttgcgatttctctgattgtcgccaaaaagcacacacctctctttactgacgctatgaaaatttactaaatatgtagcgagcaaaccacatacgcccctccaataaaagtataccgtaagaaagaagaattgtcctattttactcatgcagacactgacgggaaaccaaatagtctagttgacctaccagaaaagatattttccgtgaattcacacgttgcatggaaaaaatacgaagcaagctttttgtttacgaaacatgttgatgtttagtaaacgatggtgtataaatatacttgttgaaagcgcattcaattcttcgtgttctgcgcttgaaaataagacaaatgttttcacttggggtttaaaaggaggatgaatcagatggcggcggatcttacgatgatccaaatcatattgctgacactattagctgcagcttgtggcatcgatccatatatttcaggacttcagcttagcaaaccagtcattgccgggtttttggctggtattatcatgggcgacatccagacaggtttagtggtgggatcaacacttcaattgatggttcttggtgtgggaacatttggcggagcatcaattccagactttgcgacaggcgccattatcggcactgcgctcggtgtcgtgagcggtaaaggaatccagtttgcaattggtatttcggtgccagtcggtttactgatggtacaacttgatgtgtttgcccgattttgtaatgtgtatttcttacatcgtgttgataaacatatccagaacaaggaattttcaaaaataaatcgagaagcatggctaagccttcttcctattggcttgtcgcgtgcgttaccagttggcatctcattgatctttggaaacagtgttgttaatgccgttttaaaatatgcacctgattggttaatgggtggcttgaagctcgctggagcagtcttacctgttgtcgggatcgcgattttgctgcattatctgcccgttggtaagtttgtggcattcttaattgctgggtacctgcttgctgcgtatctcaagataccaatgatggggattgctttattcggacttgtttgcgcattaattcattttaagcaacttaaggaaaaacaagccatgatgaagaatgtgaccaaaactgccatcgtcgccgctgaagaaataaccgagggggaaatcgaagatgatgaactctagtgagattagccatttcaaacatcagactctgacaaaagaggacttacgccgtgtcaatcttcgctatatgtttggcggacagttggggtggaattatgagcgaatgatgaacgttgcatacgttcatgcaattctccctgccatgataaaaatgtacggagatgattctgatgttctgcgggatatgttacagatggagatgcagttctataatacgagtccatttttgtcagccatcattactgggatggatctttcgcttcaaaatgagagtggtacgaagtcaaaagaagcagttgccgcgattaaaactggtctcatggggcccttcgctgctgtcggtgattccctttttggggcagttattccaaccatcttaggatccttggccgcctacatgggtatgaaaggaaatcctataggcgtcatcatctggctattgtgtgcggtcgttattttgggcctgaggtatttcgaattacctcttgcctatcgtgaaggcaagaaactcgttagcaatgttggtaatttgttgaacaacttgactgatgcggcaacgcttttaggcgttttcgtgattggcggacttattccgacagttgtgaatgtcattgtgccgttcaaactgacaatcggcaagaaatcactagcaattcaggcagatatgcttgatcaaattctacctgcgcttgttcccattgcattggtagcactagcttattggctacttggtcgtaaaaaaatgaattcaactcgtgtgatttgggttttcttgattggatccattgtcttatatagtttgaagctattggccgttgggtaaccagacgaaggaggtgttgaaaatatggcacaagtaaaacagccaaacgttatcctaatagtcgttgatcaaatgcgagcagatgcgttgtcttttaacgatgtgcatcattttgctagcaccccgacgttagatatgatggcaagtgaaggctataatttcgaaaatgcctattcgccagtgccaagctgtgttcctgcacgagcagcgttgctgacaggtttagatcaacaaaatagtggacgggtggggtatgaagatgaggtaccgtggaatttcacaaacaccttgccccagacttttcatgatatgggttatcaaaccgaaagcattggaaaaatgcatgttttcccttcacgaaagcgactaggatatgaccatgttcttctccatgatggctatcttcacgcggatcgtaagtatgacaaaccctatgggacacagtttgaatatgcggacgattatctggagtttttgaaatcaaaattgggtaacgatgcagacattattgatgatggtgtcaattgcaattcatgggaagcaagaccgtggccatatgcagaaaatctccacccgacaaattgggtagttagtgaatcaattaagtttctacaaaagcgtgatccaaccgttccatttttcttgaagatgtcgtttgagaaaccacacgcgccgcttgatccacccaagtattattttgatatgtacatggatcggctcccagaaaagcttgatctacacattggcaattgggaatctctttctgataaagttccaagtatttatgcgcttcgaggaaaactgaaagcagacgatgaacgtcggatggttgctgcttaccttggattggtgacacatatcgatcaccaaatcagccgatttctgacggccttaaaagagttccggcacgataaggacactatcatttggtttgtttccgatcatggagatcagttaggagaacactatctctttcgaaaggcctatccatatcaaggcagcattcacataccttcgttcatttatgatccaggcaacctaattgctgcgcacgaacacaagataaaacagcttgtaaagattcaagatatatttccttcacttgctgatctggctttaggaaagaaggtaaaaactgacggtaggagcgttcgacaactactttttggcgattatgaaggttggcgaaccgaattccaaggtgaacatagcttaggagaagattctagtcaatatatcctaactgacaagtggaaatttatctggttctctgttcgcgatgagtaccaattgtttgacatggaaaaagatcctcatgaaatgaaaaacttaatcaataacagtaaatatagtccggtaattagggaactcaaacaaaaactgattagctatctattcaatcgtgaagagcgttttgttaaagagggtaggctaaaaccaatttcggttgaaaatattaaatcaacgcttaacagtccgttagcaggaaaggatgggcttaatgagatttaaggaaatcaaaggcggctcattccagatgggaacagatgatcatattggctttgatgaagactatgaaggaccacccacgattgttcgcgtgccgagcttttctatggctgacacacctgtgacaaacgcagacttcgatgactttattgccgcaactgcttatcaaacagttgccgaacgattaggaagttcttttgtttttgaattactgataccggaggaggaacgcgtaacataccagcatgttgctggtgcaccctggtggcttttggtgccaggggcagattggcaacatccttacggggcagaaagttcaaatatagatctcgacaatcatccagtcgttcatgttgcgcttgaggatgcactcgcttattgtcagtggtcacatagtcaactgcccacagaagctcagtgggaatatgcggctggcgcaggaacagcgacaacttatccgtggggagaatcgctggttgatgaacatggttttcatgcgaatacttggcaaggagattttccaaacgataatacagcggaagatggatttgttggtactgccccagttaagtcgtatgagcccaatagcaatggtctatatcagataatcggtaatgtttgggagtggtgtcgaaatccacgatatacattattagatgatttcaacgcggagcaatttaaactgggaaaagttcctgcagcaggtgagtatgctatccgcgggggttctttcctgtgccattgttcatactgcaatcgatatcggactgccgccagaaacggtgtcgatttacagtcaaccagtagtcatttgagttttcgttgcattaaagaagttagcagttgatcatgaaagtgattttatatgtggtcgtcattttgttggccaacacgattggcgctatatctggcatgggcggtggcgttatcattaagcctgctcttcaaattttcaattgggattcagttttgacaatcaacttctattcaagtgttgcagtctttacgatggcagttagttcaacgtggaagcaaataaaggcgaagaacgccatcaataaaacatgtgtggttgggttaagcttgggctccattttaggcggtattgctggcgatataagttttgggtggttctatagccgagttggtgatgatattagtgttgctgcgcagatgctactggtcatcgtctcgttaatcgtttcattgattctgtccagtggtcgtcttcagtcacgacatttgacaggaatgccaatgatgattggggcaggattcggattaggttggctggcaacagtactaggaataggaggcgggccgatcaatattgcttgttttctgttcttgtttggatttggcatacggcaggcgacaatctattcaattgtgaccattttctttagtcaggctgcaaagattgctcaagcattattttcaggtagcgtactcatgattgatccgtttttagttgtagctatcatggttgcggctctatttgggggatggctgggtgcagtcattagtaatcacattacggaaagatggattctaatgctgtataacttggtcattgtttttgttctgctacttgataccgcaaatctgattagttatctcgtgaagtgaggtggtcattttcatgcgaaaaagtgtttcagtcttaattaaaccagcgagttcgttatgcaacttgagatgcaaatactgtttttatgctgatgtcagttctttgcggaaggttaaatcatttggacgcatgaaattagaaaccgtcgattcgctcattgaaaatgttttcgttgatttgaatgacggagatcaattgacgattgcgtttcaaggtggcgaaccgacacttgcaggtttgagatattatcaatatttccttgctaaaataaagaagcagacaaagaaggtgggtgttcattatgctattcagacaaatggcatggtcattaatgatgcttggtgtaacttactaaaagaacacaactttttggttggtttatcaattgatggcacgccgatttatcatgatctgaatagagtggatgttcgaggtcgcggtaccttctatcgggttatgcagacgaagaagctatttgatcaatatggcattgagtacaacgtgctgtgcgtgttgacaaatccattagctaaacatgccaaaaaggtttttgacttcttccaacaaaatcatgttaagtatgttcagtttattccctgtttagatgaaatgaatgcaaccagtcgtagcagctatgctttgacgccagagcgatttgcgtcattctatcagacgtattttcgcctttggttcgatcaattgcgaaagggtagctatcaaagcgttaagctctttgatgatgccatcaatcaattcgttcgtgggcgtagaaccgcttgtggcttggatggtcagtgtcaggttcagtatgtcatcgaggctgatggcagtgtctatccatgcgattttttcgcggttgatcagtatcgacttggctatattcaagataagacgctgagagaacttttttctcagccgaatacattgaactttttacagatggaacgaaaattgccaacttattgtgagaactgtccgtttaagcagtactgttgtggaggatgtcgacgaatgaaggacgcgatgtatgttaatcaagctgggaacttttgcggttatcagcagctgctttcaatggtattaactaaaagtgatacgattttaaagtatgtagctcaatcgtactttgtgaactaagttcaattacgctgtgtattaaattcattggtaaacggaagtagttaaaataatgctataagatctatgatacaaaaaacggttttggcctcttcgttcgttttagaagggatcaaaaccgttttaaatactttgatattctgtttaattataatgcacttttagtttgccattctcaatggcagtttttcaagaaaatcgtggatacaactgtcccagtagttccagtcgtggtgtccgggcgatttataaaaattatggcggatggatggcagggagtcggcagtatcagcgaacttctgattaaattgtaatattggatcttctgtaccacagtattgatagagctcaggaagctcttgatcttgttgatgcgttaacaaccaagacagatcgttttttgttttagctagcgttgtgccatgcccccaaacttgatcgtaaacatctttcagataatgttcacttccggttaaatgcaacgctgtcaataatcctttgtcatgatcgttaaaaaaggcagtaggatctaacactcctgagaaactaccagcaacttcaaacatttctggtttgtttatagcccacttgaaggctccaaatccacccatagacatccctgccacaaaatgatcttttcgatcgtgcgaaatggaaaatagcttatttgtgatactcggtaattcttctgttagaaaagtccaataatcatcaccatgtttcatatttgtgtaaaagctgtttgcaaacccagcactaatgacgaccaactgatagttacggacgtactgctcgatattcgtacggcgaacccactttgtgtaatcatcacccataccgtggagaaggtagagaacctgatattgatcacggctaaaattctcagttacttcagggatgatagcgtacaaggaagtagaatgtcgtaaagctgttgacttaaaatctagatgtagtaatgacatgatgtgcctcttatttcagaatattgagagatccaagaacaacggccagtgcaataatgattagcatggcacgggtatagttgtgatcaactttttcaaggtagaaatagacaccagtcacaacgagcaatggcaaaaggcctggaacaatagcattcagcacgtcattttggatgctaagcgttttgacgcccgtgacgattttaattggtgtgctgactttgacgtaagaggatgcaaggccacccatcatgaataaaccgagaacacttgcgccagtaatgagttgtttcacagccccgccggacagaatcttttcaacggaggcttcaccagatttatagccaaggtggaagagaaaataactttccatcaaggttactaccatgaaaatcatccaaggcgctataccggctatgccattgcctttttttgcaagtggaatgaacagactaagaataatcggcaaccacattccccaatcaatggtgtcaccaatgccagcgacggctcccattaatccggtcttggtacccacaattgcttcttcaggaatatcttgcccttgggcccgcttttcttccatggcgatggtcatccccggaatgagtgatccccaaacggcgttcgtattgaagaattgtgtttgccgttttaaggcatcttttaaatcatcagaatttttgtaaacttttcgcaagattggcgaaagggcgagcccaaacgaaaccccttgcatacgctcaaatgaatgatttgtctctgccaacagccaccacatgaaccatgatttagtgatgtcacggcgggtgatttgtttcgtatcagttgaagattttgttgatgttgtcatgacttattcctccctcgatgtttggtgattcttagcagtgaacgtaatatgcaggtatgcgaagaaaaggcctgctaaggcaatagccaaagttgggatttgactatattgttctaaaaagaaaccagctagaaaatatggtaatagactacgtttgccgatttgctgaacgatgatggcaaaaccaacagcaggcaacatggaacccgctaaacttaagccattaagcgctgccttaggaatcatatcgatgattggaccaacgtgggcaaccccaaaataaaggacaagtgcaattggaactgcgtataagacaagcttgtaaagtgttggatacagaacagatgttataaacatgccacgataattacccttgtcgatttcgcgatcagttttgtgtgctaggaacccgttaataatgaattcaacgtttgttaattggaccccaagcaatccgattgggacagctaaggcgacagcagcacccgtgttgactttagcaacaacagcaactgagcacgcaataagtgctgctaatgttggatctgacggcatcgcaccgccgggagctagcagtccgagatacataagttgtaacgcagctcccacaatcatggcagtagggacgtcgtgtagcactaatccaacccaaagggctgctgggagtggcgaaaatagaccaaacacaccgaacgtataaccaaaacggcaacccttgaaccagtagaataaaccaattaggaatgcttgaagcagtgtaatcttacccatggtaaacatcctccttatatctagttcaggctaagttattgaaatgctttttgataatttcgtctaagctgactggcttttcatcaggaactctttggaagaatatgcggacatggttttcttgaatagctagaagttcctttgcctcaagttcggatagtgcgacactttgatagactaactttcgatcagcatttgcgccgataccgccaatttgaacttcatcaactgagaatcctgcatcaaaacatttttttagattatcgactagcttgaagagaatgatataacggttatcgcctagatcttggctttttaccatatcaacgaaatcgttgggagccatcactgaaacatcaatgttagatggagctgccattttgaagacacgactgagatattcgttagttgcaagatattggtcgacaatgacaattttattagctttggtttcattgacccatttggttacgatttgcccgtggactaaacgatcatctacgcgaacgagcttgatattatctttgtatgacataatgaaatcctccattttttaaatgacttattcaacaagtttctgattaacatcaataatgcctttttgtgctgcagaagagaccttttgaagatattcgctataactaagatttgactgttctcgatccaatgctgcttccaaaaccattggtaaattcatgccggcaaaacagttaaacttaagatcttgcatggcggcaatcacgctgtttgtagggctacccccaaacagatcagtcaacaccaaaacatgatcaccattggtagaatgcgtcttaatctcatgtcgcaatttttgagaaaattcgtcaatgctatcaccaggattcaagacaaaagaagtgatatttttttgcgggccggcaatcacctcagcactattcaagatgccgtgtgctaaatcgccatgggacgctaagatgatataaatcatagtcgttcgtcctccttacatttaaataaattaagtgtggttctaagcaagcgaggggaaaatagttgaacctgattcatacgtttacaaaccagtcgctcattatgaaccgcttacacttttatacgagcaagaaacgtgccaacatgtgtcgacgccgagaaaacttttcttttggcatgaatgtagcagatgcatgctgccaagcagaacaattgtgtattagttaacaaatgctacaatgtgttcgacagatactttgggctgaactaaatgtgtcgaggggagattaacatgagttttgaagctgtaaatagggaattgcgtgaagaaacacaagctattagcgacttaagcgatattaacaaaatcacaactgaccgcattgctgaaaatcttcatttgagccgcacgacagtcagtcagtacttgaacgacattttaaaaaagggcgatgccattcaaatcaagtcacggccaaccaacttcatcaatcggcagattttttctgaacgttttttctcgccgaaacaaacgatatatccatcagtagcctcactaataaaagagcaggttcgccagaaaaatgtttttaagactttcattggcaatcaagaaagtatgaaggaaatcattgagcggctcatcacagcggaaaattacccgccaaacgggctacctgtcatgctttcaggcaacacaggtgttgggaaaagctatcttgccaagctcacctatcagtattgcgttcaggaaggtttgttgaagaaagatgcaccattcgttgtcttaaattgtgcacagtattatcacaacccagagttgctctcaagcaacttatttggatatgcgaagggcagttttacaggagctacgacagatttcaaaggaatgctggagtcagcaaatggcggcgttttgtttttggatgagtgtcaccgtttaaatccagaaagtcaggaaaaacttttttcgtttatggataccggtaatttcgagcgaatgggagaaaacgcggtgtcgcgatcaagtaaagttcgcttgatctttgccacgactgagaatctgcaagaaaattttttgcagacatttcttcgtcgtgtaccagtcgctgtcacattgcctgatctgaataatcgctctaaggcagaattaaagatgttaattttccaaacattcattgaagaaagccggcgtttgcaacgctacttcagggttgcgccgtggatcatcaatcacctgttcaatttgaagtataagaataatattggggaacttaaaacaacgattaaactgatttgtgcgcatgcttatagccaagatcaaatgaatagtgacattgaaatttcgtcagataatattggtaatagtttgctacaacgattaacggccgtgaataaccaagaagaaatatgtagtgaagtagttaactttacaccggaaagtcgcctgaccgacttcgttgatacgacgatcagtgagaattctagagtcaatgatttgatgacgcatctttgtgacgtggagggggaatttcaaaatgataagctgacggcagccatggtgattgaaatcatttctcgtgaatctagagcgttaatggatgaaatggttcatcgagataagcgtgatcacaacgaatctcttaagtacttaatcaatattattcaacagttgtttgattacttaggaagctcgctttttgtaaaaatcaaaggtaatgcagtgattgcctttgccagcttcatttatcttaagcaagaggttgatctggccttaacggtgaaagctgagaaaagtgtccataatcttttggaacttgcgaaacaaaatgcgacggtcgagtatcaagttttaaagtcttttcttgaattgatcaaaacaaagctggattttcgaatgggtgaagttgataaactccttctcctaggctatctcattagtcttaacctcaattacaaaaccagcaacaagcatgcgattattctggcccatgggtactcaacagctagtagtattgcagacgttgccaatcagtttttaaacaagaaaatttttgactcatatgatatgccattgaatgtttcgatccagcaagtgaatgattatattcaacagtatattcacaaaaatgattgccataagggtctcattattttggtagatatggggtcattgatggtattgcctgattcgttgaaggctaatattaacggaccattgctggttattaacaatgtatctacgcagctcgctctttttgtcggagaaagtatagagaagaatatcgcatttaatgaaattggtaagttgatgactgataagcttacctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaatacatcgccgcgaccttaggccgctctcgtatttctattaggcatgagcttcaccgttgccctgaaggtgattactgcgccattatagctcaggatcatgccgatacttgtcggcatcgttgtggtcggcactcgattttaacgcctaagttgaagcggatggtaactgagaagctaaacctaggttggtcccctgaaatggtcggttatgccgttcactgtgcgccacacacgatttaccactggatttatcaaagacaagtcgattttcagccaagccaactctttgatcacggtaaacgtcataaaagaagacaagaccttcggtcgcgctataaccaagcagtaggcacctcaattgagattcgcagtgagtcagctaatcggcgaaccgaaaaaggacatttagagatggatacagttcgcggtggtcgcgggtcaaaggctgctgttttgaccattgtcgatcgggtgacacgtttaatggcgacaactaagcttgaaaacttatcacaaaatgctgttcttaagggatttgcaagactgatggtggactttccgggtccggttcgatcagtgacggttgatcacggtaaagagttttcctgcgatcaggcgcttacaaagcgctatcggataccggtttacttttgccacgcctatcacccgaatgaacggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggcttactccagaatatagtttaatctatccggtcattaagaagagtccaatgattattacgacatgtcatactggaattggttccgcaaaacaaattcaaagtttgcttgagcatagtattccaaccagtcttcattacaaaattgaagctgtggacttggaatatctcaaaaaatatggcgatagcaactctgtttttgaacagtatgatgttaaggccattgttggtacgagtgatccgcacattaaaagggttccctatatagcacttgagaatctcatcgccggagacggtacgtctgtggttaagacactatttccagacgtcaaagacatggcacttttgaaacgtatcaataattatcttgtcgaaaatctttcagtggaacggcttctgtctgctgtcacaatcctagatgctaccaaggtgatcagttcggttagcgatatgatgacagagcttgaagagaatacaggaattcgtctgacaaataatcaacgtgtgacgctttatgttcatgtaagcgctatgattgaacgactaatcagaaatgaaccaccactggtttataaggttgttagcagcgaagaaagaaagcaaggatgtactaaaatcaaacgggctttgagaaatattgaaagctcatatgggatcaaagtcgatcaaaatgagttgaactatctctatgacattgtgtttcagctatagattatctttggatggacaacacaaagggaaagacaatcaaaatggatcaatctattagactcaatcaacggcaaatcaataagttggtgctaacgcaaggcatgcgacagtcaattcagatgttgcaattagacgccgttgatttagatgcatatctcaaaaacgttgctgaatcgaacccttttattgaagtacgctctcatcttgagcgggcagaagattcattatctggcgcaacatttgaagaaatgtcggctgggagcagtaccgaaaatctttttgatcatttattaatgcaagttcaactttcactagctgggaatcctttgcgccaaatcgtcgtttatttaatcaatcaattaaataacaatggctatctgattctggaggatagacagatcgtggatgagatcggtatttctcccgaaaaattgaccgaagctatgcggttactgcagggactagatccccccggagttggcgcccgtaatcttcaagagtgtctatcactgcaggcccatcgtgatactggcataccaaagggagttattgccatacttgatcaggattttgaactgctagtttcgcatgatatgacacgcatttgcgaaaagaacaatttgtcgacgaccgaactacacaatgcgcttgacttcataaaatctctttcggctgctcctgggaaagtatttgagcaaccgcaaccaatttcgtatattattccagatgcaaggctgagtgttactaatgatggtcaacttaaactatggctgacaaagtggggtcgccctgagctggtatttgcagaaaaaacttatcaagacctgaaaaaatcagcagattcagcgacacaacagtaccttaaagaaaagcacgaggagtatttgtccctgcaacacggtctacaacgccgcgaggagactttacttgcgacagttaatcaaattgttgtgaaccaacatgcatttttattacatcaagcggctttggcaccgttacttcttagagatgttgcaaaagcacttcaagtcaacgaatcgactgtgagtcgaacaattaaggggaaacatttacagacagatcttggcatttttgcctttaaggactttttttcgaagcgtacacaggctgtatcaagtagtgcctatcattctgttgatcagttgaaatttacaatgatgcagttgattcagtctgaaaataaaatgtgtccagcaagtgacaaccttttagtcaaatggttgtacgaaaaaggctttaaagttgctcggcgtacggtgaccaagtatcgcaatgagctcgggcttcctgctgcttcagcgcgaaaatcgagatgactgaaataaaaaaatttttcgtgctcatagtcgttaactggactgataattaaaaaatggatttgcaacaaaaagtgcctgccattcgtggaacttgaatgaacgacaggcgctctttgttgcaatttttttgacatcatgattccaattatcagatagtcttcaaaatctgttctggttcaccgacatgtgagataggcatctccataaacgcactatgcgacatagttgattgtagaagcggtcacaagaaagtcgtatcacttttagtcttaaacatgatcaaagtatattagaggagttgaatctagtttacgaggacaatctttatgtcctcttcaaaggacaaaattctgtaagcgctttctaagctacctgagataatgatgatggaaggagatgggaccagatgaccaccgatcttgcgcagtcagtgattcatctacttcaagaccaacaaggtttcataacttctaatgagctggccagaaaacttcaagtttcttacaaaacaattcagagggttgtgagccgcatcaatagcgggtatggcagcaacatgattacttctgagaaaggtcgtggatacaagctagactatgaacgatttcttttaagcaaactaagtggaaaatctcctggagatcattccttaccggcggaaagacagaaggcactgctaaaaaagttgctactcgcagcaccttccaaattgaaagtcggtcagttagccgaagacttcttcgtcagtgaatctgtcattcaaagcgacgtcagctctttggaactatggttgagaaagtatgacttaagtatcacacgggttaacagaacactaagtattcgaggtgacgagaaagacatccgtgatgccttgatggaggtgattctaggtttgagtaaagacacaacgatgaattttgaagcgatgacgcaaggattagctgaacatgatacgacatttgcactcaaacaagtggatgttgttgcccagtttttaaaggctgctctaccttatccttacgatgtgaacttgttttcgcatatctatgtgctgatcagcagaattcgaaaatttgtcaaactgcccattgaagatcaagacatcacaagactgaaagaaaaagtgcataactatccggatctattcagcgtgagtgaaatggtaaagcgcaatttggaaaattatcttggagaatcaatctcggagaatgaagtctattacctatttcagtatttgatttctgcgagatttaccggaacggatttcaaaacaaaagcagggacatccgcttacacgttttctgaagcactcatagagttggtttctcatgatatccagttgcctgacgataaaccagcaatgattgaagaacttgtcccgcatgtcgcgccaatgctgaatcggttagaaaataatattcgtctccccaatgcactactgaaagaaattcaaggcgagtatcccaacgtttaccattcggttcttcatgctactgacatcttagcaaaagagtatggcttacccgagatttctgctgatgaagttggttttctatcactctacattgctaagtacatggagagttttaagaaacctaagaaggcgatcgtcatttgcacaactggcttgggatcatctgaattgatcagcgcgaaaattcgaaaggatcttcctgagctggaaattcttgatgtcatttcaaacctgaacttggaaaaatctttagccaagcaccctgatgttgatattctcattagcaccatcaatcttcctaagcaaaagcagattcctcaggttttagtgagtgctatgtttacggggaaggataagaacaaggttgaagaagcattgagggggcgatgagatgggtaagaagtttgcgattcacattgaatcaatttcgcctaatgcagtgggaacgattgttaataaaacaaccatccttagaacaatttctgatgcgttatcaaaagtgtccggacagagcgctccacaaatacaatcagcgtttatggagcgagaaggcgtaggaaacacagcgctggagtcaggtatcgctattccacatgctgtattagatgggcgccaagtgccggtgctaggcgtcctgagctatcccagcggagttaaagattggaaggatttgaatggtcaacccgttactcaggttttggcaatattgatgggtaaagacgaaattacagaacaagaagccaatgacatcaaaagattttttgtcaaattggcatcatcagattttttgcggaagatagctcgaagcaaggattcacaaacagtggttgcagtcatcaaacaacaaatggaggaagaataacatgttagtatctggagatcggcttttacaagtagctaaggaacatcatttcgcaattccagcttttaatgctgggtcaggtcaattatttactgcgaccttggaaaaagctgaggaattgcaggctcctttcattatggcaattcacccgacagagcttgattttctgcgtgacagttttgtcgcgcaggtaattgatgcggcaaatcatacggatctgccaatcgcattgcatttggatcacggggcttcttatgaacaagtaattcatgctattcatcttggctttactagtgtgatgattgatgcctcgttaactgattatgagcacaatgtagctttaacaaagaaggttgtagaagcagctcatgccacaggcgtttcggttgaagctgagctcggcaccattgcagacacgggtaacgatgttgagggccatctaacagacaatgtgaagtacacggatccagaaactgcaaaggaatttgttgaagcgaccggtgtggattcattggctattgctattggcacagcacatggcttgtatccaaaagatgtcaaaccgaaactgaagccggagattgctaaggcagtagctgaagtcgtggatgtgccactggttctgcacggcgcctctgacaatccggacgataagattgcagaggctattgcgtatggcattaataaaattaatatctcaagcgacattaaaattgcatttgcaaaagacttgcggactgttcttaacgaaaacgatcctgatgaaattcgtgaacctaaagtactcttcccatcgccaatgattgcaactcaaaaagttgttgctcaaaaaatcaagttattcggggatgtggatcgaacaaaactgtattaccaaaatgaaccagttaacgagattccgtataatgttaagaattttcaagttgaacattttagtgcttgatgcagtttaaagaaaaggggggccgatttatggaacagattgatgaagtgcttgatccgagactaatcaagctcaatttaaatgcatcttcaaagcgagatgctattacgcaactatcagagaccttgaaagatgcagattatatcaacgatgtcccctcttttgttaaagacatttatttaagagaaaaagagggcattacgggtattggtgatgggatcgcgattccgcatggtaaaagtgattatgtaaccaaggtaggcgttgctattggtgtctttaacaaaccgattgaatgggaaacattagatgatgaaggtgtgaccgttgtcatattatttgctgtcagcaataatacagaatctgctcgtaatcagctaaagttactttcactatttgctgcaaggctaggacatgaggacgtcattgaaaagcttaaaaaagcgaccagttcagcagagcttattgcagcttttactgagaaggaaggtttaggacaatgaagatcgttggtatttctgcttgtgcggcaggaatcgcacacacctatattgcaaaagaaaaaattcttcaagccgctaaagatgccggtgatacggttcatgttgagactcagggaacgattggaacagaagacgcgttaacacccgaagagattagtcaggccgatgttgtcttattggcaattgacgtaaaaatctcaggaagagagcgctttgctggcaagaaagtagttgaggttccgactgatgttgctattaagagtcccaaaaagctcattgccaaacttcatgagctgactgggaagtccagttaaacgaggtggatacaaatgaaaaagattcagattaagcagcctgcgcttactgcgatatcatatttgattcctgtcgtggttgcgggtgggttcttacttgctgttgggaatattatgggtggcaaaaacctagaagcagtcaaaggcatggccaacatttgggatgcattttcgaccatgggcggtttaattctcgggatgttgccaattgtcgtttcaacaggggtcgcgttcgcgatcgctgacaagccagggattgcaccgggtttgctggttggtcttatttcaagaattattggcgccggctttcttggcgggttaattggcggttatgtggcaggttgggctgcaatgctcgtgattgcttacgtgaaagtgccgaaatgggcagctggtttaatgccgacattaatcattccatttcttgcctcactgattgctggtctgtttatgttctatgttctgggtggaccaattgcggctggaacagtctggctcacaggctatatgaagacactggatacaagtcagaagttcctttatggcatgatcattggtgttctggcgtctgtggattacggtggtgctattaacaagactgttttcgcatttgttctggcattacaagctgaaggcattaacgaaccgatcaccgttttgattttagcatctatggtcacaccaatgggctacacactagcctatttcttaggaaagttggttcacaaaaatatttatacaccgttggaagttgaaacattaaaaacggctttccccatgggactagtcgagatcacagaaggtagtttaccaatcgttttgaatgatctatggcgaagcgttgttgcaacaggtgttggcggtgcggttggtggcgggttctcgatgttgtggggcgctgactcaaagattccggcaagtggcctgttcgcagtaccaactatgtcacggccatgggcattcatcgttgccctgatcatcggtagcgttgtcactgcgctcgtctacttgattttaaagaaaccagtttctgctacggacttgcaagaagaaaaggaagaagaggacttgaacctcaaagatcttaagatttcggattgaagttaatgtaaggagatatggcatgacgagtgaggcattcataggaaatgaagctcaaacttctggtgctcagacaatccaatttcttgaaggtaaagctactggtatgaaagccgtgcggatgtataacgaggctggattgaacttattggtggcgccagatagaggaatggatattccagagttgaaagtacacgggacaaacgtatcttttatgtcatccactggtcttgtgaacagcacctattttgttgagcatgggaccacgggatttatgcgaaacttcaatgtcggatttctgacaacgggtggcctcagctatatgggagcttctggcgattcggagctaggtctgcatggaacgattggaaatactcctgctgaaaactttagtcatcaattaacagcaacggaagtaatagtcagcggtgctgttagagaaacagctatgttcggtgtgaatttggtgatgaatcggaagatcgtgattcccaagaatgaaacaaaaatacggattcatgatgtcgtaatcaatgaaggcgttcaccccgcctcattgatgatgctgtatcatatgaattttggttatccattctttagtcctgagtcacaactagtattgaacgcggctaaagtaacggatcgtgatggagatgacgtaaatgattggaatcggtttgatcaaccggcacctgacacgacagaaaaggtctactttcatgatttttctgaatatgcaaacaaagattttcaataccgacttttaagccccacgaccggattacaggcagtcatcacaattttcccttctttgctatcagtattgaacgagtggaagttaactcagacaaaaaattacgtacttggtttagaaccagctacgaataatgtcaatggtattgaagcggctaagcggtcagggaacttgaaaataattgaaccgaatgaaagggtgacctttgacttagaaattgccttttcaaaactggaggtgtagatctagatgaaacgatctgaaatcaatcaaattttgaaaaaatcagaaatttttctcaaggaacatctggtgtttctgccaccgtttgcgcaatggatgccagtaaactggcaaaatcttgataaatcctatcaagaaataacggataatatgcttggctgggacgtaactgattttggctctggagacttcaagcggtacggactagtagcttttactttccgaaatggaaattataaagagtcagaaaaatatcctaaaccatattgtgagaaagtcttgcttttgaatgagggtcaggagctcccatatcattttcataggctaaaggaagaggatactattaatcgaggtggaggaaatctcaaaatcactgtttggaattctactgaagatgaggctttggatgaagagaaaccagttcatatcgtaaaggatggacacaagttggttctggatccagggacgattgtgacgcttcatccaggggagagtcttacgactaccactggcatttatcacaaatggaatgtcgaacccaactctggtgaggttatggtttgggaggtttcttctactaatgatgacaacattgataatcgctttctgaaagatgtgtcacgcgtgccagatattgatgaggacgaaaaaccatatcggcttttgttcggtgattataagaagttgtcataaagatatgcctgaagccgtttgtgcttcaggttttttaacatgaagattggtactgacagattgtgttcacgctttattactaagcagtcccgccatcgcgggctatggaggtcttgaaatgacaaacgaggttgttcttggtattgatttaggtacaagttcagtgaaggtattagccttatttcaaaatggcaaatttcatacacacgctgagccgctgacattgattcatccccaaaacggatacaatgaacagcgcccggaggactgggtcacgcaaacttttaaggctattcgaagtaccttgatgaaccacaaaatttcgggggatgctgttaaagcaattagcttttcaggacagatgcatgggttggttgctctaggaaaagatcagcaagttctgagaaatgctattctgtggaatgatacgcgctcagctgcggaagttgaagagattcaaagtggcatggggcaagcttatattgatatcacaggcaatcgtgcagttgaaggttatgtccttcctaaactgttgtggttgcaaaaacatgaaccgacgatttggaatcgaattgacaaagtgctgctgcccaaagattatctccgattaagaatgaccggaagtcttggcactgattattcggatgcaacaggcacaggttatctggatattggtagtgggaaatggagccgggcagttcttgagcattttggaatatcgcttgattggatgccaagattgatggattcaggcgagattgtaggcgggttaacccaagccgcggctgatgctagcggacttttgactgatacgctggtcacagttggtggtgctgataatgcaatgggagcaattggcgctggtgttgtagaagaagaccaactgatgtcgagtattggcacatcaggtgtcatgcttcatccagagaagaagttgcgtttaaagtataatggcagtcttcaactggagagacatgcgattaagtcacgtttttattcgatgggggtcacattagctgcgggtaattcgttgagctggttccgcgacacttttagtagggataagtcgtttgaagacatcgttcaggatgctgccacatcgtcaattggtgctcatggcgttttgtttgcgccatatttgtcaggagagagaacgccatattttgatccgcatgttcgcggtggttttatgggcatttctaatggcactagttttaatgattttgctagggccgttttagaaggaattgtcttttcgcttaacgatgttcttaatctatatagacaatttgaggtgctgccaagtgagattattgcaattggtggtggtgcaaaaaatacattttgggcacaaatgcaagccgatgtttttgatttaccactcaaagtgccagtcgttgacgaaggtccaggttatggggcagcaatcgttgcttctgtggccggcaattggttttcagatgttgattcggccattaacgagttggtgaaatatgacgtcaagtacacacctattgcgggtaaccgtgacgcctacgaggatgtttataaagagtatcgccagttttatcgccgacttgcataagatttgtgagttatagaagacgcctgaattgattgggcgttttttgatagttttaaaaacttgttgatgtttataacagacacaatctgtcgtgtcacacccgtgtgccaaaatcacaattaagtttgaaagcggaatcatttagtatagagactgtaagatagaaaagaggagcaaacattatggcaatgttcacaaaagataatatggtcatggatctccaaggaagtactcaaaaagaaattctggaagatctagctaaaaaggcttatgaaattggcgcagttaaagatgccaccacattggtatcagattatttggagagagaagcagaatcaacaacagggtttggcaatggcgttgcgattccacattcaaaggcagagaacaacgtcacagcaaccatcatctttgggagaagcaaacagccaattgaatggcaatcacttgatggacaacccgctaatacatttattagtttgattgttccagcagccgaagcaggtgttcatttgcaattgttagcaaaactcagtcgtcagttagttcatcccgaatttgtcgatgtgttaaagaatggcagtcaggatgaagtttatgaattgattgcaaagacgatccaataatcactgcataaaacaatgtcaataaaggaggagaacatgatggctgacttgaagattgttggcgtaacaaactgtcctgctgggatagcacacacgtatatggtggccgaagcaattgagcaaaaagctaagtccctaggatatgaagttcatgtcgaaacgcaaggggcaaatggcgttgaaaacaagctaacagatgctgatattgcggctgctgattatgttattttggcgttaggtaaaggcatgagtgctgaagacaaggcacgattcaatggtaaacaggtcattgaattgcctgtttctgaagcccttaaaaagattaatgttatttttgataatttacatgatgaagcacatttgtacacggcctctaaagtccagttaggtgatcgtaagcaaacagatggcattatgagtcatttgatggctggtgtctctgcagcattaccgtttgttatcggtggtggcttgttgatggccttgggtagcttgatggttcaatttggagctgcgaatgttgctccgaaggctgggcaaatggcctcacttgcatgggtgttgaataccgttggtggattaggctttacaatgatgattccgatcatgggcgcctatattgcttattcaataggtgataaaccagctttagcaccggccttcttagtaacgtatctagccaataccccagatattttaggaacacagggaggcgctggttttctcggtgcgattgttatcggcttgagtataggttactttgttaaggcatttaggaaagttaggttaggcaagacgttccagtcgacattgggctttctcattattccgttcgtaacgcttttactttttggattagtgacgtactaccttttgggaccggcaatggcttggttaatggcagcattactgggtttcttgagaagcattccaccagaaatgaagattgctggaggattcttagtaggggcgatgctggcctttgatatgggtggcccaatcaacaagaccgcttggttctttggattttcactgctcagttcccatgtttatacatggtatgggattgctggcgttgtcactgtattaccgccaatggcagctgcgattgcgacatggattaaacctggtttgttcaccaagcaagaacgtgagtcaagttggcctgcaatgttagtcggaatgacagttgcaactgaaccagcgattccttacgcgttagccgcaccagtgccaatgattactgcgaatacattggccggtgggattgccggcgcaatttcgatgggacttggggttgaacgtttggcaccgggacttggtgtctttgatccattgattggcttgtctcggccggcatgggcatactacatcgctttagcagttggtttagtcttaaatgttttgtttgtcattgttttcaagtcagcgtggctcaaacgacaagaacgcaaaaatggcattattagcttagacaatcagccacagagtacgattgtcggtaatggcactagcgtttcagcagcgccgacgcaaagtgctcagacagcaaagacaatgtctcctgaagccgcaaagaaatagttattaaacacgatgggtgcaggggctgatgtctctgcacctttttagaaagaagcgatgcattttgacaaaatatgattttgatcgggtaattgatcgacatggcacgtttagcacacagtgggattacattgcagatagatttgggcgaaatgatattttgccattttccatttctgacacggattttccagtacctgttgaagttcaggacgcgttgcaaaaacggttcgctcaccctatttacggttatactcggtggaatcacgagacgtataaagacagtatcgttcattggttcgagagagatggccacaccaaggtagattcagattggattgtttatagtccaagtgttgtatttgcaattgcaacgctgattaggatgaattcacaggttggtgatggcgtggcagtctttacgccaatgtacgatgccttctatggtacgattgaaaagaatgatcggatactgatgccaattcgcttggaagcggcagatgcaggttatcagattgattgggacagtcttgcaactgtcttggccgaagaacggacgaaagtatttttgctaacaaacccgcacaatcctactggtcgagtcttctcaaaagccgaattgaaaaagctttacgatctttgccgagttaatcatgttttcttgatttcagatgacattcaccgcgacatggtttacctgccacatgcttatgaaccgattacaaatattggcacggaaaatgttgcgctgtgttgttcaggttcgaaaacattcaatacgcctggactgattggctcatacgtctttttacctgaaccgactttgcgagcgcagttcttgacagaattgaaacaaaagaatgccttgtcatcggtcagtatctttggcatgttggcacaaattgcggcttataatggatctgaagactatgttcaacaactgactgcttatactaagcataacttagagacggtggccagttacctgcgacaaaacttacccgaagtcaagttttcacttccagatgcgacctatttggcttggattaatgtgagcggattgaatatcagttcagacacattgcaacgtcaattagttgatgtcggacatgtggggattatgcctggaaagacatatggcgatgctaggtatttgagaatgaatattgcctgtccacaagaaaagttattggatggcttggaacggctaaagaagggagttaaaggataacatgttacccctcagagaagttaaaatcttacgcctattgtcccagcaagatttctctggggatgaattggcgaagcagttaaatgcatctcggcgaacaatcgtccgagacattgccgcgattaatgatgaaattcaaactaatcgtattggcagaattacaacgcagaataaatatcatctgacaacgctgaatcccggtaaattgaccacactattaaacacaagtcgtgatgaagcaaatgaaatattacttcgactatgtattcggcgaacagtagcaatgggcgatttgacggcggacatgtttctgtcgcgtgctcaggttgctgattatcttgttgaactaaacagtgattatcatgatctttttcatatatccagtcgcccaggaactggcgtgacgattaatatgaaacggttaacacggatcgatatagcggctgactgcatttttgaatttccacaattactggacaaagttgtgccggaagttgaaaacacgcaacgagtcatcacttatttgacagcaaacccttgtccttatcaggagtgggtcattgatagccagtggcgagcgcaggtaatcagcgccttcgtttgcctgccaccgtcaaagacacattcgtccgaagcattgacaactactttggtgcaccagtttgttcaaggccgtgcagatcttttggcaagtttaatgtcaaaacacgaaagtattgtacaaaaattctctcaaacagccgacaagtttcaattggaagcaattggacagaaaacactggagtcattgttcactcactttggtcgtgagtgtgcattcccgcggcctctgagtactttaagcaactttgatattacaagactttctgctcaaaatcctgttgcctttgattttgcacaagcagttacagttgaactattaaagacagataatcgaatgtggatggatgcaaacttcttggctctgtatattgttcaggcaattaatcagcgagaagtaaaaccggttaaaattctttttttggcgcctcgtatgtcgttagcccaaattaattcaacgattattcagcagaagctgcataacattgtactttataccgttcatagtttgacagatgcagaaactgcatataccaaacatcattttgatttagccattgctaatgttcgaaatgacgtcattgaacaatcttcaattaaattttccttgacgttttcggctgttgcctctgatgaagacattgcaacactcgagcagttagtcaatggtcagtattatcatgacaatatcgcagcaatgctcgcaccaaatcattttgtcaacgtaaccagagcagacaagtttttgcctgtgctgagaaaggggctacaaagtttcaacgaaacaggattgctgactgatgcagatctagtgaagatcgttgaacgcgaagaggctggcaatcaattaattttaaaccacatttctattccgcatattgtgacatctagtgtctcagattatcgcttatttgcgattaaacccgatcgagcgatcactgttgaaaatcaggaagtttatttaatggttattgttctggttggcacctcgcaagcagagaaaaatacaatttttagttatttatatcaaacgttaagaaagtacacggtcacgaatattagacaggttcaaacctatcagcaagttattgaattgcttaagggcatgatgcagtttgatggctgaagtttgggcgaaggcttaggatcaacaacatcgttttgcctttgataagacctctagtttgaatgtttgttttaaagcctccaaccacaaagtttggaggctttttgctatgaagatactgataacgccgtcattgtaacaactgtttgaagatatttaagaaagtgaagtcacttcttatttgctgtgtgtgatccagcaataacaatgaatttccggctaaagaagttgtgccggaaaaattgtatttttgtcccggaaaaagatataccaatgtaaccgcttgctgacatgcaataatggaattgtcaggaggtggggtacttaagtagtctgtgggggaagggggcaatcatgaacgagaaaatcaaacaattgcttgacatcttattgcagcaaaagagctaccttaccgcattgcaactgtccgaaatgctaggtgtaactgaaaggagcattcgaaactatgtaagaaccttaaatagcagcgagacacaggcccctttgattgtttcatcaaataaaggctataggattcaacgtgatctgtataacgaaagtatcgagaatcggctttttgctaaagacgatgctgacctgcttttcaaaattgccctaattctaatgaaccaatcgacattcatcacatttgatgaccttgcagttcagttgaattactctgttgagagtattcgaagtaaggtgcaagctttattctcaaagattcatgatatgaatctacacgttacgttggaatcacgaatctttacaggtattcgaattttaggagaggagaaccaaaaacgactacttctagaacaattaatacctattgaagaaatcgtaaaaggaaatttgaccgagtcaacttttaagttattaggaaagctgtcaagcaaagaggctatcaacacagaaatcagcagtattgatacagttttctcacggcaccatacgacgatggacttcattgtctacgcaaagattatttgccatatgatcattgctgtgagccgttacaaagatggccattcgattagcttgtctgaagttggcagcaacaataagagtcatcctgaatttcaactagcttcttctttattagcgatgtctgttttaccaattaacaatgaagcggaaacaatggcgcttacgaattatctaatagccttgccgttgaatatgccaggagcgtttgtgccggaaatgaatcaactgcagcgcaatcggttagaagcttcattaaagagggcagaggaatattatggcattccactttattctaacgagcgttatcgagctcaaatcatgaatcatatcatgagattacttgatccgttggaagaaagtataccgatttttaatccatactctaaacagacaaaaagagaatacctgtttgcctattcgatcgcatgttttctctatgatgacttggaaagtgattttcgtttacaaatacccgaatcagaagtagcttatctggctattcatattcagcttgttttaactgaagaaacaaaaaatggcatccaaacaaaattagtttttcaaggtaaaaaagccgagggagaattgtttcggtacaagattcagacctattttccccggatagatattaagactgtcaccccaacaatggttcaggcggacttgcagaagtaccaactgatcattcgctgtggttttcaggaacctgtggctgctaattctaaaattgttgagattagcaaagagatgaatacaagagacatcgcgaagattcaaaattttgttgaaaccgttggcacagcttctttaatccaacagcttgattatcatcatatgaatgaatcttccagtgagtctgcgattgagtatttattgaaaaaatcagggtacttcaaccttttgccatacttccagaagcgcgagtccatgtcaccaacagacattgggcatcttgtggcgatgccgcacccgtttttaaaagggtcagagacgactgccaaggtcattatagggattaatagaacagaaattccgtggggacatcagaaggttagattaattgtgatttatattcctgcatctgaccttaaaacaaacaaaaacttctttaatgacgtgtatgagcacacaagcaatttagcggaagttcacgccttattggaaaccaaaacaaaagaagaatttattaaagtttggaatagaaaaggagattattcaaatgctttataacatggttgatttactgagtgtcgcatataaaaataattttgccgttggatcctataatgttgcgaacagtgagtttgttgaagcaattattcacgcagcagaagctaaaaatgcaccagcaattattcagattcatcctaacgagatcaatttggtgggcgacgatttcactgcctatgtcagacaagcagttgatcgtacgcgcataccaatggccattcatgtggaccatggggcaacactaggggattgcgtacgcggcattcataacggatatacgtcagtcatgattgatgcatcagcaaagtcgtgggatgacaatgtggcacttaccaaacaagtcgttgatgtggcacatagcgtgggtgtttctgttgaagcagagcttggaacaattgggtctaatgaactttcaacagaagggacaggtgtcaacacgattctctataccgatccagaagacgcaaagaagtttgtgagtttgacaggtgttgatactctagctgtcgcaattggtacgcgtcacgggcattatagtcatgtcgaaaagccggaactgcgaattgatttacttgaaaagattcatgaagctgtggatattccactagtcttacatggtggatcagacaataaggatgaggaaatcaaaaaaacataccttcacggtgtagcaaagattaacctttcgacggatatgaaaaccgcattcttcgcccaactacgcaaaaatttggatgacaaccctgatgcctatgagccagatcagttgatgccatcagctaggaaggcagcgcaagacattgttgaacacaaaatggacctttttaattctaccggcaaagctgacctgtactagaaataatgatcgaggaatccaagcttggaggtgaacaaaatgcgtattgacgaattaattgatattaagaatattgatactagcattgaaccaatgacgaaagatcaagccattgcacgcatgatcaataaactaaaactgaatggttatgttcaagacgcagatacattcagtaaggctatctatcaacgcgaaaatgagatttcaactgcagttggatatggcgttgcaatcccgcacgctcgaactagcgcggttaaaaaatcaacgatcagtgtctttagagatctctctggtattccgtggggacaggaaaaagttaatttagtgttcatgattgctgctgaggaggacgcttcagacgaacatttgaagatgttgtcaaagatctcgacttttttaatggatgagagttttcgagctaaattgataactgcagcagaccctaatgaaatgtacaaaattcttgttcaagaggatgctaagaaaaatactgaaacagatatttcgcaagcacgagaagctgctggaaagtatcttgtcgggattagtgcttgtatgaccggtattgcacatacgtatatggcggctgaggcactggccaatgaggctaaaaagcgaggcatgcgggtcaaaattcaaaccaatggttctactggtgttgaaaatagacttacctcaaaagatattgaagaagctgacgcgattgtggtggcgcatgatgtcaaagttgataccacagtttttggctcaaagcctttcttggacgtacctgttaagcgtgccatcgaccaaccgagttcagttgttgatcaagctttagagaaagatgcaacaagtccaaaatctgctccgacgcataagaaccttgaagcagctttagggaaagaaaccaaacctgaagaagatttgactgggggcggcaaatttgcccgcgctttttacacacacatcatgagtggtgtgtcctatatgattccatttgttgtcgtcggcggtatctttattgccatttcctttatgtttggtatctacgcttcagatccgaagagtgatcagtacaatatttgggcagcatttttcaatgaaatcggcggtaatgcggcctttaaactctatgttccgattctcggtggctttatttcttggagtattgcagataaagcaggcctagcccctggtatgatcggtggtatgatggccgtcaatggcgggtcaggcttcttagggggcatggtcgctggtttcttagctgggtatgttactcgattcattgtcaaaaagacacagaatgttcctcactcatacaaaggtattatggcggtattagtgatcccgctcgtagcaacctttattgtcgggctcgtcatgtttttccttctaaatacaccaatgtcgaatatgattgggttcctgacaaactggttgaaatccatgacgggcgtgaatgctttcttgatgggagcacttcttgccggcatgatggcctccgatatgggtggtccaatcaacaagactgcttcggcttttggacttgcaatgttcgcttcaaagatttatggaccttcagcggcattgatggttggtggtatggttcctccgctcggcattgcacttgcaaccgtattgtttaagcgcaagtttacaatccaagaacgcgaagcgggcaaggctaactgggtattgggagcaagtttcattacagaaggcgcaatcccatttgccgcagccgatccattaagagttatcccagcaaatattatcggcggtgcagtcggtggcgcactctgcatggcagcaggtattactttgcaagcaccacatggcgggatctttgtcatcccaattgcttgcaacaagccaattctttatattggttgtatcttagttggaacagtcattacggcgctcattttaggctttaccaaaaagactttgaatgagcagcaaatgaatcaacggatggctgccggtattatctaagctttatgcaaatctcaaagtgaatatggcgggttatttgtcctcagaaagttcggttatagttgcgactataccgggcttttttaatgctgtttatttgagcaattttaatttttaaaccgtaagcgtttacaaagtgaaaattagatgctactatgatgtcgagatgaccggacgtctagacaaataaaagtgtggaggtttgtatgacaaattggatcagtcttgctggaaaaagagttgtgatcacaggtggcagttctggtataggcagcataatcgtcaagcaaatgctggcaagtggtgcgaaagtatcctgtcttgacgttaagccatcggagtatgaaggccaatatttcttttttgagtgtgatattagcgaccaaaatcgtgtgaacgcggcgattaactcagcagctgaaaagatgggtgggatcgatgtcttgatcaatgacgctgcgattaactcgcctaagatgatttacgatttttatggcgaagaggcggggcatcaatatgatgatcgagattttgatagacactttgacatcaacgtgaaaggggtacttcattgcgttcaagcggttatgccacatctgttgtcaaataacggtggcaccattattaacatgagttcagaagccgggagtgaagggtcagttggtcaagcactttattcggcaacaaagggggcggtgaatgccttaacattctcaatcgcaaaggaactgggtccgaaaaatattcgggcggtagcggtcgcaccaggaattaatgaaccgacgccgatggggaatagtcagcatgtagcagatcttggctatacacgcggggattttaaacagagtcgagaaaaacaggctgaaaaatatctgagcaatattccgctgagacgcgtagggcgattgagcgaaatagctgatttgattatctatcttgccagtgatcattctagttatatttctggcacagtggtcaacattactggagggaagtcccatgggtaattctaataagcgtgaaccatggatcattcttgtatcacatggtcacatggctaaagaagttctagctagtggctgcttaaaaattctataattcaggcagttaagctaatatatgcattattgcggtataataaatccattggaattagctgttttcctgcattttccttgcattttttgggaacctactcggaggttatcgtatggtctatcgtcacagcccgcttcaattgtcatttgaatcctttggtgccggtttaagtaccccacttagctctaacaatgagtggatccagttggcggaggtcatgccctggaaagctctcgatgaggcataccaattggagttcaccaaaaatgcgggacgtgcggcaaaaccatttcgtttactctatggggcaatcctgatccaacaacggatgggtttaactgatcgtggggtggttgcggcaattcgtgatacacccgcacttcaatatttcatcgggttgtccgaatacaaagcggttgagccgttcaattattccagcctggcacactttcgcaaacgaattgccgatatctccgagctgattacgaatatcatgaatgatacagtacgcgccaagatcgaagcgttggtcccattcaaagtggacaccgtcatcacggacgcaaccgcagtgccagtcaaaatcaagtatcctcaagacaccgtcctcctcaaccaagcaaggctgaatcttgaggcgatggcgatcgatatggcacaccaacttggtgtgccaaacccacgcatgtacaaacgcgaggcgaagcattgttggacctcattttcacgacatccaaagcaacagcgtggtggctttcataaacaggtcaaggcccaacttcaatatgtgcgccgtgatttgcggtacatcaacgaattcatcgatcagggtgcgactctaccagatgaacaagcgattcgcttaggcgtgattcgaattctatttgaccagcaatggtacatgtatacccacaagactcaccacgttgaagaccgaattgttagtctccaacagccgtacattcgcccaattcaacgtggtaaggccaatgctaaagttgaatttggggcgaagattgactgttcgttaagtgaaggcgtagtcgacattgaacgttttgatttcaccgcattctctgagggccaagacttcgcggaaactttagaccactattacgaccttcatggacattatccggatgaagtactggccgatacgctgtaccgtaatcgggagaacctaaagctgtgtaaggatttgggtatccgaatctgcggtccgaagcttggccggcatccaaaacacgttgatgcagcgaaacggcgtgaggatactgatgccgagaatcgaagaggtaccattgaacgccggtttgcttttatgaagggcacgctggggcttgacttggtgaacactcggacagctgaatcactggccgtcaagattgacgcggccatcgtcttgagcaatgtgctgaccctgttaagggtatttgctataccaattttaattttggctaaattcgagggtgaggcctatcaaattcgctataaatttactacaagggtcgaagatatggcggcctagttcaacagccactagctagcgcggaaatgattatgggcaagctaaaagaagttaaaacattttcgctaattgagggggaaagcccagagaaattgatccatcaaatgatggcaagtttgcgagatgctccggagaattcaatcattttagttgacttactcgggggaacaccatcgaatgtcatttcaaagatagcaagtcaacacgactatgcggtcgttacgggcctgaatttgggaatgttgatcgaagcggagatgttgcgatatcagaataaggacaatgatccgcgtcaagtagcagagaagcttgttgaatcgggcaagaaaggcattgttgatttgaaaaagaggttggcagaaacctcaattgaggagggggaattgtaatgctggatggtgtgaaattaaccagaattgattatcggttgattcatggacaggtcatcacgaaatggactaataaagccgcagcgaatcgaatcattgtcgtaaatgacgaactggctaaagataaatttatggcatctgtgtatacgatgtctgcaccacctggagttaaggtacaaattgcaacaattgatcaatttgtaaaagcatctttgaaagcggattcatcactcgataagggcaatattctacttttgttccggtctattgccgatgccctgactgcaagtgaagctggtgtgcactttaaaaccattcaagtaggcggtcttgggtcaggtgatgataaagggatggttgttaagggagtttttgcaagtgcggccgatattgatcagttggagaaaatccaagcaaaaggatcagaagtgtccttccaagtcacaccagaggagccaaaactgtcattaagtcgagctaaagcaaaggttggaggggaataacatgttgggtgtttcaatatttaccggtatttattactggatcatgaaaaccgatgttggttatggttttactcacgcgatgaggcaaccactgttttctgcattatttattggactcattatgggtgattttacgagagcaattgttattggggccgccattcaaattctatatatcggattagtcgctgctggatcaaacttgccagcggacgactgcctggcaggattaattgccattccaattgctattgcttcgcatctcagtccggctgtcgctgtgacaattgccgttcctgtcggcgtcttaggtgttttcttagatcaattcagaaagacgatcaacatcgtttttgttcatatggcagatcgatttgctgatgaaggtaaacctaaacaagtggtcatgtcagcgatcgtgtatccgacgttgttgtcattcgtttatcgctttccggttccttttattgccaatatgtatggggcaaaagctgttactgcatttatggatgctatccctaaatggcttacgaatgggtttggcgttatgggtggcttattaccagccttgggatttgcattaaccatgtttgttattggcgataagaagttgttgccgtggttctttattggattctttattgtcgcttatctgaaactgcctgtcatgggtgcagctatcattggcgggtgtgcgattctgttgatctctctggcacaaggtaaacgagaagaggaggagactttataatggctgaattaaacaaagggcaaactgcagagaccatcacctcacctaatcagactcctaaaattactgagaaggacgtcaagaacagttggttactctattatcttgttgctgaaatgggaatttcctacgaacgattacaggctttaggctttacggtttcgctactacctattctgagaaaactatataaaacaaaaaatgatttaaaggatgccatcaagcggcatctggtcttttataacacagaggccgtatttggttctcttatcaacggcattgtcatttcgatggaagaacaaaaggcacatggagaagatgttacctcagaggcaattactggtgtgaaaacaggtttaatgggacctctcgccggtattggtgattcgattgattgggctacattgaaaccgattatatttgctctggcggctacgttatctgcctcgggcaatccaattggcgcgtttgttctgctgctactgccaattgttcaagtgattgttggacgtactttagcgggtattggttataaagcgggccgtgagtccatcacggagatgctcgcatcgggtagaattcagcaactgattacaggtgcaaaaacgatggggttgttcatgatgggcgcgctgtcgtcaacttatattgccgttaagacccccatcaaaattaattttggatccgggaatacaacatttgttcttcagaaagtgtttgacagtattgcacctggattactttctcttgcagtcgtgatgttcatttactggtggcttaacaaacgaagccaaaatctgtcaatcgttgtgttgctcattgtggcaattgcgcttttaggcgcctttactggtttcttagcgccactaagttaacggaaggacatgaagacaatgaaaaaaagcgcagtacactttggctcagggagtataggtagaggttttattggtaagcttctgcatgattctggttatcaggtcacaatgttggacgttgatgacagcattattagtagcattaatgctatcggaggatacgatctgtatctcattaatcataattatcaaaaggtttttattgatcaggtgagcgcgattaatagtctgaaggatacgcaaggtgcgattgatgctattaaggacgctgatatcatcacaacagcagtattggcaactaatttggaaaagattgcccccatactttctaaaggcctaaaggcgcggttgcagcttagaaaggccaaaataaatattttagcttgtgaaaatctagaaaacaactcaggggtcctacgaaagaaggtattggcactcggagaaataaaggaaaacgatttagagtcaattgccgcatttcccgataccgaagtggatcgtttagtcctcaaatctgagaggaatggagagccggctattgatattggcgatgagtttgaacttgtggttgataaaacaaagttggtcaatccgggggttgaaccaattaaaaatgctttttacacgacagatatccacaaatattttgaacgaaaactcttcatcatcaatactggccattgctgggctggatatgttggtcatgtatacggctataaagttattcaagatgtttttgcaaacaagccgttgctacgcgcaacgcgagaagccatgaaagaaagtgcggtactaattgagaaaaagtatggtttttcaaaagatgatctagatgactatatctcatttgcactcaatcgttttatgacgccgggcgtggttgaccaaattgccagagtatcacgtaatccaattcagaaaattggccctcaggagcggttagttcaacctgtccagcaactagcagatcgcaacttgccttatcaacaactagttaaaggaattagcgcggcactgctgtttgaccttgatacagatcaacaagccatcgagctacaacattatattgagaaaaatggagtaaaacaaaccattgtccactttacagggattgctgaagaatctgtactcttttctcaaatcatggagcattacaaccggtttaagcaaataaaagaaaaacgaacgaactgaaggaggtggtcagattgtcgctatcattttccaataaagaaggtgtcactattcctattcgtatcatcaataacttgattaatgagaaggacactttaagtgagctggatagcttcgttggtgacggagaccatggcattaacttagcaaaaggtatgacgctggcaaagaaaaagatttcggttgcaaatgacacgatgtcttctggttttgaaaaaatagcccatgcacttgaaaatgaagttggcggctcgcttggtccacttttcggatttttctttgaagcaatgagctcggagtcgaaggatcatcaggcgatcgatggtcaggtgatatatgacatgatgactgctgctgcggaacaagttgcttatcttacagaagctaaggtgggggacaagaccattgtcgatgttctttttccagcagtggatgcttacaaggaatcatgggaacaaactcaaattactcaaagtgcattaacggccatgggaaggtctgctcaggaaggattaaaagcaactgcaaatatgctggccgcttatggacgcggacatcgtcttggtgaaaaagtgatcggacatcaagattcaggagctacgacaatgaacatgatctttcaaacgtttatttcagaagttgagaaattagttgcttaattttaaagagggggaagttaatgagtgacttgcgaagatttgttaatgatccagaaaaagtggtcgaagacgaactgaatggatatctgttagtccatggagatcaagttcggcgatcagagagaaatgctcgtgttctcgtgaatcgccaaagaaatcctcatcgtaaagtggctttgatctctggaggaggaagtggccatgagcctgcttttctaggctatttaggaaaaggctatcttgatgctgtggcagtcggtgaggtttttgcctctcctccggccgatgccttcttggatgctgctcttgaggccaatatcgatggcgaggttatcgccctgatcgggaactatgctggagatgtcatgaatatgaagatggcggcagctaaggcgggccggcagaacgtccgaattcatattttaactagcaaagatgatatcgcttcagctcctaaagaagaaatcgatagacgatatggcatggctgcaggcttctttacttggcgctttgcgggttatctagcagatcaaggattagatgcagaagaaatcgttgcaagggttgagaatctgtccaatagcattcgcagtattgtggtcggcctgtcctcgctagaaattccgtctgctggaaaagaaaattttgttgttcctgaaggaaagatggaattcggtattggccaccatggagaagctgcgattgatacacctgaactgatgtctgcaaatatgatcggtaaaaagatgaccgaggctctcttgaatgattatgcccttgaaaggtcaacaagttttgtagccatgatttcggggttaggagcgacgccaccaatggaacagtacattatggcagatgctgtgaatcaagcatttaagacattaaatcattcgttaagcaaggtgtatgtcggtaacttcatcacatcacttaatatgaatggtatttcgttaacccttgttccagcagaatcacaactcgtgtcctctttagagacgccttatcaaccaaatgaatttaaaaccttttagggagtggtacttttgaccaaaacaaaatatcaagttgcgctagattctttctcattagatgatgcggtcaagtttgtacgaaccatcgaggactacattgatattatcgagattggaacacccttagtcattgatgaggggatgcatgcggttcgtcggatgattaaagaatttccaaacaaggaagttttatctgatgaaaagatcatggatggcggttatcacgaggctgatcttggctatcaagcaggcgccaagtatgtcactgtgttaggcgtggctgaagacaaaacgattcaaggatgtttagatgcagcacacgatgcagatgccattttggttgtagatacgcttaagattccaaacttggctgaacgtgctaaggaagttgaggcgatgggggttcattttatctctgtgcacacaggttttgaccagcagcagatgggaagaacgccattaaatgatcttcgaatcgttaaagcaaatacaaactcaatccgggtctcagttgcaggaggcattaattccaagactattgaccaatatctagctttagagcctgacgttgtgattatgggaggcgggcttgctgacgctgacgatccagtagacgaggctcgtaagattcgtgaggcaatcgaaaagcatgaaacggagggaagcagacaatgacagatcgaagcttgaacacgatccttgaagagttaactcaaaatgctaaatttgttaaggcagatcaacttcagtcggcaatcaattcaattatgaatgctaaacgaatctttcttgctggtgccggacgttcaggatttgcggctcgtggattcgccaatcggctcatgcatttaggatttcattcaaattttgttggtgacactgttaccccttccatacagaaaggggatttgctaatcattggctctggatctggtgagactgcaagcctagttagtgatgcgaagaaagctaagcaggttggagctcatattggaacactcacgatatttcctgaaaatacgattggcagcctatccgactggcatatcgttattccgggggttacttcaaaggttgatggtgaaaatacggaacatgggcaatcaatccagccccacggctcatcatttgaacagttgagctggttagtatatgatgcccttgtggtatatttgatgcaagagacgaaacagggcgacaacgaaatgtttgcccgccatgcaaatttggagtaaaaatagagttaagttggtacgctttgggcgccggaggcaatgaagactattaccggcgagtgaggcgtactttttttgtaggaaggggcgattttcatgaagggagaacggatcgattttgccgagaacgttcctctttacattatgattgaatccgctgttgaacagcgactcttagatggcacctatcaagttggcaagatgatcccaacagagttcgagcttatggatgagttctctgttagccgggaaacagttagaaaagcaatcaatttgttggtccagaggggaaagctcgagaaaaaacgtggaattggtacgtttgtagcttctccatctgaaactgaatggcggcttaacaatctttccaatttcaatgctatggctgcccacgctggtcaccatgcagaaacaaaagtcataagtgctaaaattgtcccatccgataaccgcttaaagcgaatatttggtagtaaggtaagtcagtataattattttgaacgtgttcgatcattggatggcgatccagttgaatacgttgaaacctttgtaccgctgaaagtcgcgcccacactgcaaactgtattaaaagacaacacttccctgtacaaggtgcttagagaccaatataatgtcatcgtttcgcatggtaaaaaagagttccaggcatcgaatagtacgagcaaagaagccaaatatcttcgaatcactgagggagatgcagttcagttagtcgcaacgacagtatctgataaagctggtagggttgttgaatattcattggctagaaataatggtatcgtcagttcgattgaactcgatatccaagttaaatgaaatacttgtagccttaaatgctacaattcatggttagataaaaaaagtagcgaacacatttttggcgatgtgtccgctactttttaatattcagttttacaagctagtttcgtgtttaaaaggcagttaagagttttaaacattgaggacggtagagggtggcttgtctaagcatcgtagtcaggttcatttgcaagaatccaatcttcggcttcttttgaccacagaccgtcatgcttggcaagaattttacctaggtctgtggcaggatctactttcgccaattcaatacgatcgaattttttgccactgtaaaccaacttttttccaccgccaatttcaggttgattcatcgtcgtttcacctgcgtcattcaaacccataacatgggtaatgactttggagacatcgagtttcttctcggcaattagctgtgctgcttcagcttcattattagcatcgccacctgatgtaccaacaaaatgagtgaaattatagtgaatgttatagaaatttacagaagctgagaagtctttcttcattggacctgcgaactgatttaagcacccgtcaggattgagcagagagtctgctaaagttgctaacggcgcaacgctgatcatcaaaaatgcgtcatcatacccactgccatccactgcatctagaagagcttctttctgttcatcaattgacaagccgttgacgttgacaaatttgatgtctacccaatcagatgggtacagtttctttgcgcgatccagtttgtcctgattgacgtccgtcacaacaagcgtagatggcttctttggaccatgtaatgcataatcaatagccagcaaccccatcgggcctgtgccgcccatgattaacatattgccaccctctttaatccctgtggttggttgataagagtggaagttaacatggtactgtgctctaaatgctgcgatgacacaacttactggttcgcataaggagccctcataataagcatcgccctcaaatggaattaggcagcccatcgtcattacttcatcagggatgataatctttgtggcatcgccgccaatatatgggtatgagtatccaggaacaaacggcgtatcttgacgagccaaatttggttgaatcacgtagttttggccggcatgaaactttgattgccactttttacccacttttaaaatcttcccagaaaactcatggccaagtactgctggattatgggccaagtcatctggtgtcttcttatgatcttcaccctccattgcaagtttccatgatgacatacacatcgtgtcgctcacaacagttgcaagaatttcatcgtccttcatctcaggaaggtcaaaggtgtcaattcgaagatccttcttaccgtaaattcgtaatgctgtgctttgcatgttcgtgtcctccattcacaagtgtgatatttaatttagaagcttacttatcttggctacaaactgatggtaattcagtaaatagaaatggacaagtaagcgctatcaaatattcacaaatgtgaaatagttaggacaagtcttttattgattttgctgttgcttcagttgtgatcaaagtatttaagagtccgccacgcaaagcagcaaggatagcagtgactttatcttcgccaaaagcaattccgacagaatatggcactttctttaaggcggataaagggagggcaacaagaatagagtcaatatcacgagttactttgccgtttttatcgaagggatgggaaaggatatcgcctaccatttcagcgctgaaatatgacttgaagtttgtgttctcataaaaggcttgccagtcgggtgaatcagtgatgagcgagctacccatcccaaagattgcaatattgacacgggtccacaggctaaggatttcttgcgtgtttggattagctagcagctctttacgtaaggcttttgatctgacaaaggctggcgagtccaagacaaaggccgttccgtttaatcgattcgcgagccgatgtgtcaggtagtttacgtgatagttcgaaggaattcttcccattggtccgccaacaagtgggacaactttgatgccatggagtttattatcggttggaaattggctgataacgctggacaaagttgatccccagcttaaaccgatcacatcatcgcttttgatgatttttgacagaaacatagaagcgtagacacttaatgcgttcaattcattaccgccattctcagatgatgggacaatgacggcgtctcgaaggccgtacttttgtttgaagaaatctactagttggctaaccgcagtcgtttcgggattaatagcaattgaaacaacgccttcatctctggctgccttcagaattcgacttatttctgtgcgatgaatatgtgcgatttcggagatctcttgttgtgtcagaccatgcatgtagtaaaggtcagatattttgactaatgttgctcgatcatatcgctttggtaaatttgacattattgtcacctcaaaaatcacaaatgtgaaattattgatcggtcttcttgtaaccggttacattccaattataatcaaaagtgaaacaggtaacaacatacatttaacatttgtgaaggtaggaaggagacgcatcatgtcagattggcttggcttgtcaggaaaaacaattattgtcacaggcggttcatcaggtattggggaagccatcgtcaaagagttgctacagaatggcgctaatgtcgtcaatggcgatctaaaaaagggcactttagaggatcaacatctaacatatttcaagactgatgtcacgaatcccgaagaagttgaaaatcttgctgcagaagcagagaagattaatggcgaaatttggggtgttgttaataatgctggcattaacaagccacgcgtcttagttgatccaacagagccacatggaaagtatgaacttgatgctcgtacgttcgatcagatcttcaatgtcaatgttaagagcgtttttctggtttcgcaggcagcggctcgccgaatggttaaacaacatcatggtgtcattgtgaatatgtcctccgaagcagggctagaaggttctgtcggccagagtgtctattcagctagcaagggagcgatcaatggctttacacgttcatgggcgaaagaattgggcaaatacaatattcgagttgttggcgttgcacctggcatcatggaagctaccggcttaagaacacctgattatgaagaagcattggcatatacccgagatacaactgtggaagccatcagagcaggctacaagtccacatctacaacaccaatgggtcgaagtggaaagcttactgaagtggctgatctagtcaactattttgtttctgatcgtgctagctacatcacgggcgtcacaaccaatgttgcaggcgggaaatcgcgtggttaataggattttaagattggagatgtgctagatatggaaataattttagttgggcatgcacatactgctaaggcttttaaagaagcggtagagatgatttatggtgaggtgccaaatttccatccaatagatttcacgccaaaagaagggttgcaatcgctgacagacaaaattgtttcggcaattgaacctggtaaaacggcaagcactttaatcattactgatctattctcgggaacaccctacaatgcgtcagcagaattagttttgaaaaagaaagcggcggatgttgttgcgggaatgtgtttgccaatgctattggaggtcgcagttaacgcaaatagtatgagcgttagccaactggtttcacacttgatgaaaatcaaagaagagttttcaacgagccttagcgagaaaatgacaacgaatgcaaaggaggacgatttctgatgattatcacacttgcgcgagttgacgatcggttaattcatggacaagttacaacagtttggtccaaagaatcgaacgcagatcgcattattattgtcagttcggaagtttataaagatgatattcggaaaaccttgttaaagcaggcagctcctcctggcatgaaagtcaatattgttgatgtaccaaaagcaattgccgtttataacaatcctaagtaccagaatgagaaggtgttttatctatttacaaacccacgtgaagttgtggacttagtaaaaggtggcattcctctagaaaaattgaatattggtggtatgcagtttaagcagggaaaaactcaaattagtaaagcggtctctctggatgcagacgatgttgcagcatttcgggaattgcaccaattaggcgtaaaactcgatcttcgtgtcgttaagacagacccgtcgtcagatatcttagcaaaaatcgatgaagtttttggaaaggaataggcggtgactatcaatggcaatttctaccattcaaattattcttattttcatctggtcctccgtagtcggtatgggaagcgttctggatgaatttcaaacacatcgacctttgatcgcgtgttcgattatgggactgattctaggcgatccaaaaaccggaatcattttaggcggtacgctcgaacttattgcactcggctggatgaatatcggggctgcacagtctccagattcagctttggcaagtaccatttcaacgatcttagttattgtgggtaatcaggatattcaaaaggggatcgcgattgctttgcctgtagcggctgcaggtcaggttctcactgttctggcacggactgttacggtggcatttcaacatgctgctgaccgtgaggcggaaaaagcgaactttactgccatcatatggttacactttacagccttaattgtacaagcgctccgggtctcaattccgaccacgattgttgcggttttcgtaagtccagaagagattaagagcatgttagatgcattgccagaagtaattactggaggactagcagtagctggaggattcattgtggttgttgggtacgcaatgattcttaatatgatgagtgttaagtacttaatgccattcttctatctaggctttgttctcggcggttatttgaaactaagtttgctagcttggggcgctgttggactgatctttgcgattgtctacgttcaattgaatcctaagtttgcgacaaatcataataacggcacaggtggctccggtgggacggttgcagcggctggggatcacccggctgccttaccagaagacgagttggacgactgaaagggagtgtattgaatcatggctgatcaaccagtaaaagtaaataaactaaaaacaaagattacaaagggagatatgtttaagacctttgtgttcgaaaactttcaacaagcatcttttaactttgaacggattcatgcacttgccttctgtgtcgatatgattccaacaattaaacgggtgtattcgaagaaagaagatcaagttgcggctttgaaacgtcatcttgttttctttaacacaacacccgctatgtgtggcccgattgttggggtgaccatggccctagaagaaggcagagctgccggtgagccaatcgatgatgggactatcaacagcttcaaggttggcttgatgggacctttggcaggtgtcggcgatccgcttatgtgggggacattgcgtcctattcttgcggcactaggggcgtcactggcccttcaaggatcatggttaggcccgattctattcttcgttgcttttaacgcagttcgtctatcgcttaaatggtatgggctgcaattagggttttcaagaggtctggcactcgttaaagatatgagtggtaatcttctacaaaagattaccgaaggcgctaccgtactgggtctcttcatcatgggcgttttagtcacaaaatggacaaccatcaatgtgccgttagttgtttctaagacaaccgttaatggcaaaacaacagtcacaacgttgcagaatattttagatcagttttgtccaggactcttggctctgggattgacattgctgtgcatgtatctgcttcgaaagaaagttagtccaattcttttaattttcgcattgtttggtgttggtattgttggttattggctcggtattttgaagtaagggtgagttaaaacgatcaatcaaaacacattaataattgcaatcggactcattcttttgaccagcggtttcttagtgaaacctgagaaacaaggcaagaagcagaaatacaattttctgtatatgattgcgggtgtcctcatcgtactaatcggcttgaaagtaatttagggaggggttgttcaattatgccacttgtatcgacaaaacagttggtgacaacggcgtatcaaaataaatttgctgttggagcattcaatgtcgggaatagcgaatttgttaaaaatatcattgccgttgccgagaaattagagtctccggtgatcttagaaattcatccacttgaatatgagttgatggggagcgccatctttaaatatattcgagaggcagcattaaccgccaccattccagttgccattcatctagatcatggtaggaatatggcggatgtgctgcgagcaattcaagatcaggcaaattctgtcatgattgatagttctggacttccttttgaagagaatctgaagacaacaaaacaagtcgttgaagttgcacacagtgttggcgtttccgttgaagcagaacttggcagtattgggaatagaaagttcacagaagaccagaatatgggtagaatttatacagactccgaaagtgctaagcaatttgtcacagaaacaggtgttgatgatctagctgtggcaattgggacagttcatggcccatatccaagcggcgaaaatgatatacgaattgacatcttgaaacaacttaatgaaacattgcagatgccgctagttctgcatggtggatcagataatcctgataataagattcgagaagcgattcaaaatggcatatcgaaggtaaatatttcaacagatattaaagtgccgttttatcatggcattgctaaaactgttgcagataaaccgggtgaatacgagccatggattatgatgccatatgcggatgaggcgcagaagaaagtgattgctgaaaaaatacgtctgtttggtagtgatcataagtcgaagctttactttgaagacgcgaaacgcttgacaccgtatttctgatctctatttggaagacagtattttagagaacgattcaatgaacctacaccgcttcttgagatcattagaaatcatcgagtgctttaaacaaaataaagaggtcgcgatatcttgttgaggtatcgcgacctcttttgtatgcagaaaaccgaggcttctgaccgatttatttaaaaataatggatgcaagtgggtatccgacaaaggataagacgaccacacctactagtgcaagagcaagcccatacttcagcatgattctcaggtctacccaacccgaaccaccagcaagtgccattggaattgttgaaggcggcgttgaccaagcataggaagcaccagctgcaattagaactgtcagtgctgctacattaacatttccaagcgttattgctaatgggatgagtaaagaatagaagacagttgccatgatagtgctagatacaaactgttttaacattacaagtaggaacgtggctactagtacgaacagaaaactggaaaagtcgccaacaataggaccaacaatttttgcaaagtatttggtgatacctagtttatcctgaactagtgcggcggaaagaactaaaactgcggcgttgaagatgagtgtattccatggaactccttgtgttgaagccactttaaagtccataactggtttgccttcaacattaattaaacagagtagtataaccccgataaatgctggaatcgcatttccaagagaggacatataggctccaaaggtaggaaaaatatttccaattgtaccttgaacaatccaaattgcaataacgctgacaaaaacaaccgcagcgattttttcttgcttagacattggaggcagttcgccgcgcagtttttttgaatcaaaattttgaagagggcgtacatctggacgataaaagaacttatagattagtataaacgctgcaaagacaagaacaccagtcacgatgcctattatgctgtaagataaaacatcaatattgatgtttgtgtcgcgagcaaggaaggttagcggaattaagacgatagcatgtccgatcggtgtcatcgaggatccgatacccacacacattgctagtcctaagataatcatctgaggtaatcggtccccctttttcaatcctagttctttaaataattcctcagcaattggtataaatactaataaagctgcggtttgggacatgaaagctgagaggaagactgatgcaaagagaaatatgatgatgaaagtccaaggcccgcggcttgcaaacttattagaaactgaccaaattgcaatgcgttttgagagacctgtttgggccattacatagctgatcatgaaaaaggcgtaaagaaaggaattcacccaatttcccaatccattagcaaagacctcagtctgagtcatgatttgaaatacaacgatggtagtcatacaaagcagacttgtccacccgattccggcaaaattccaaagtagtagcataccaacaaagatacctatcatttgcatgctgtcggctgttagtccggctggagcgggaatgaacctaaataggaagataagcgcgaatgaaatcacctgcataataaatttgacgttaatttttcttacggtagtttgtctgttagctgtttttgctgtggtttgcatattagtttacctcacaggtacgtgtgattagattttcttgatccatgactgcttttatttcagatgtaggtaagttataaacatctttctgattgctaattgcgtaagcgaagatagcgccgacggattctccgacattcatgacaataggcattactctagttgcagcgaatgtttccgcatccgttgatatggctttaccaaccaccgctatatttaaatcttgtttaggtaagcaaacagcaaatgggatttggtagattccatttatttttagaaaatggacttttttggtaattggatcgtgaatatcaaccggataacaaccaacaccaacgcagtcatcgaactctcttagattgctgatatccgatagttttagtgttgatcgaccatcgagcttaacactcgctcgaatacccattattggtgcgatgttggaaaggtaagccttatcacatccaggaatcttttttttgatgaatgccacgattgaactgatttgttgtcgtccttcgcggagcccctcggaaagttgttgtgcatcgcgataatcagtgttggttctcgtcacattgacacttgcatccatggttcccggaattggcgcaaatgccagaatcttgcccttaataatgccttcatcaaatgcctgattgacaactgcggacaaagcaccactatcgataaaatcttgaagtgttcgtaaatctatgtttgataatctgaatatctgtgttgaaacagctatatcattgctatgcattggctgtacttgacatccaaggctagtagccactagggagttactggttgcgtcaattagatattttgaagaaagtcgaagcggatgaccaaaattttctgcttgaactgtaaagccgctttcggtttttttagcggattcaaaggtggtattgtaataaacttgaacattatttttggacaatagctcttccaaaatcagttttaatatttctggattataacgaaggcgatctaccttaatatccttatctgaagacataggtaactggtaatagtatttgccggctttttgctcaagtagcttttcaaatatttgcttttcaaatccgtgataaattggttttttcaagaatgatgcggcgttgaattcggccagtcccgataaagtggcatttcctccacagaccgagtgttgttcaacgatagcaactttaactttcttcgatgcagcctttatggcggctagaacacctgcagttcccccaccaatcacaattaaatcaaagttcattgattcatctcctcctcgctaatgtttgaacaacctgttcaaaagatcacaccgacagaataagatagcgctttcatttgtgcaatcgattatgtacgatatttgtatcgataaaaccgatacaaattttgacagctaacgagggggatactcatgaaccttaaccaactaaaatattttatggtgcttgcgcgagttggatcttacagtgaggcggcttaccaattgaatatcgctcaatcaactttgagccaagcaattattaaacttgaagaagagttcgagacaccgttgttttatagtgagaagagggttagttatctgactggagccggaagtattctagaaaaagaagcgcagaagatcatcggaaatgttattgaaagtaaagaaatgattgctcagtatttaaatggtaatgttggaaacgtgacgattggcgtttctggttcatttggtgtcacaatagttcctcaagttattaagacgtatcaaagatttcatccagagaatcttgtgactgttaaggttgttcaaggcaacactaatcgtctagttcaaagtattcgtaatcatgatatagatttaggaatttgttcttattcgccacgtgatgtcgatgtgcaattctcgctaattaagcgagaaccctatgttgtgatgactagcaataatcacgaattagcaaaccagaatactgtttccgagcaagatgtccttaaatatcccatcattacttttagtgcgcaaagtggtgcatattatgatgtggctaatatattgggagttgatataaatcaacttgacgttgcaatgtatgtggacgattcagccatgatggcagcaatggtggaagctgggattggaattgcggttatacctcgcatctatttgcttgaaaactttaatattgcgatactgcccttcgagacagttcgatatcgggatgtttactgtgcttggttaaaatatcagctgctttcgcctgttgcaaaagaatttagatcgttgatacaacaatctgcaaatattactttgtagaatcatgttagcaaccttcttcaatctgttacttgtgttgtgactttactgaagtcttgacagtgctatctggcttgttagatagcacctttacctttacacccgaacatttctcggctaaactcagaatacattcagttatttcaaatcttggtggttatgttcacaacaagcacatcgtcaatgatgcaattggaatactgaagaaaataggatcgcgttcgacaaaccgattgggcgccaatgggactgtcgacgcaagggggacagaaaatggcaaagttagtcttacaaacagattttgggttggttgatggtgcggttgctgcgatgtatggcgtggcctatggcgttgatggtgagttgtcgattcatgatttgacgcacgagattccgccgtatgatatttttgcagcgtcttatcggttgtatcaaacgacgaagtattggcctgaggggacggtttttgtttcggtggttgatcctggtgtcggtagcgatcggcgtagcattattgcggagacggtagatcatcatttcatcattacgccagataatgggacgttgacgcatttagcaaaatttgtcggattgaagcgggtgagtgtgattgatgaggcatcgcatgccttgcctggcagccaagagagtcatacgttccatggtcgtgacatttacgcttacaatggcgctaaattagcaagtggccagatcacctttgaggatcttggcaaagaaatcgaacctgagcaagtggtgatgttgccattgggtgaggttaaagaaggcgttgatcaaattgccggtacgatcgacattttggatattcgatttggctcgttgtggacaaatataccgttggctacctttaagaaacttggtgttgcagctggcgagtttgttcaggtatcgatttattatcacgatcaattgcgttatcaaaaccagatgccgtttacccggacatttgccgcggtgcgggttggtgagccgctggtttacgtgaattcattactgaatcttggcgttgcgatcaatcaggactcattttcaaagctgtatcatattggcactggggttgattggcatatcacggtgaagcggctttcggtataattgaatgcatgaacagtctgctggcggcgatggctttggcggctgctcaacacgggtaagtaacggtacgtttgacaaggagggcaatcatatgcgtgatcaaaaggctttgagcgtacgtacagtggtggcaatcggtattggtacggctattttgtttattttgaaacgatttgcggtgattccaacagggattgcaaatacgaacattgacatttcttatggctttctcggctttatcgcaacgcttttcggcccgattgctggctttttcatcgggtttttagggcatgctttgaatgattttacgcaatacgggacaccatggtggacatgggtgttcacgactggtttagtcggtatggtgatcgggttgttctggcgtcgcttcaatgtcgaagcgggcaattttggcatgaagaaaattgtaagcttcaatctgttgcagattattacgaatgtggtgagctggagtctgatcgcaccaacactggatatttggatttacagtgagccggcaaataaagtttatgtccaagggatcgtgtcagctatctcaaatagtattgcgaccggtgttattggcaccattttattggtcacttatgcagccacacgcacgcggtctggcagtttgaagaaagagtcttaatatggcagcaccagcaattcagcttgatcatgtcacgtttcagtatgacagtcaggcggaaccgactttgcatgatattaatctaaccattcaaccaggagagaaagtactgattgttggcccgtctggatcaggcaagtcaacgttaggtaacttgatcaatgggttaattccgcacgcttttccgggcaaattgagcggcaccgtgaccgtcaacgggacggtggttcaggatgccagcttggcgacactttcactgcaagtcggaacggttttgcaggatccggatgctcagtttgttgctttgacagcaggcgaggatattgcctttgctttggagaacagcgctgtcgcacctagtgagatgcatacacgcgttaaaaaatgggccgatcgtttgaaaattggcgatttactggcgcaagcaccgcaatcactttcaggcggccaaaagcagcgggtggcgatggccggtgttttgattgatgaaggggatattttactgtttgatgaaccgttggccagtcttgatccggccacaggtgaagcatcggtagacttgattaatgagttgcatcagacttatcacgtcaccgaagtcatcattgaacatcgtttggaggatgtgttgcggcggccagtggatcgattagtcgtgatgaaggacggtcgaattattgccgatgatgccccggaaactttattgcatggacagttgctgcaacaaatcggattgcgagagccgttatacttggaagcggctgagtttgcgggggttgatttggatcaggcggatcatttggctgacctttcgcgttttgaggccccacaactcagacctaaattggctgctttcacagcggaggctgcgactgttaagccggagcagcttcaggcaccgttattgtcgattgacgggttgcagtttggctatcctaatggccgtcaaatttttaccgacctcagtttcaccttgcatcatggtgagatggtggccttggttggacgcaatggggttggtaagtcaaccttgagtcatttgatcgctgggtttttgaagccgggtgctggcaggatgacgcttgatggtgaggatttggctgattggtcggtgaaggaacgcgccgataaaattgggtatattttacaagatccaaatcagatgatcagtaaacacctgatttttgatgaagtcgctcttgggccgcgtttacgtggttgggacgagacgcgtgtcaaaacagcggtcattgaggcgctgaaggtttgcggcttgtatccatttcgatcgtggccgatcaacgccttgagttatggacaaaaaaagcgtgtcacgatcgccgcaattttggtgctagaaccggcattaatgatcttagatgaacccacggctggccaagattggcgtcattttaccgacatgatgcgtttcttgacgaccttgaatgaacgtgggattacgatgatgctgatcacgcacgacatgcatttgatgttggagtatgcgcagcgggctattgtattaggcgacggtggtatcttgatggacgattcgccagcagcagtgttgaccaatccggccatcattgagcatgcttccttagcacaaccgagtctgtatcgccttgctaagcgtgaaggccttgacccattagccttcacacaagcggtgattgaccaagaacggagggtgtgccaatgaactcactttttggttatgatccgcaagatacatggctgcatcgattaacaggtgcgacgaaaatgctcgcgttcattggtatctcggtcattgtgatggcgagttatgacacacgctttgtctgtgcagtgatgctcgcatcgatcattctgtttgcccaagctaaaattcattggcggcaaattagtttagtggtcaaaattattacgatttttgcagtggtcaatttattgcttgtgtttgttttttcgccacagtatggcgttggcttgtatggcagcaagcacgttttgctcaatgctggttacttcacgatcacacaagagcaattattctatgaaatgaatctagcgctgaagtatattgtgaccgtgccactggcgctgattttcttaatcacgaccaaccccagcgagtttgcagcgagtctcaataagctgcatgtctcataccgaatcagttattctgttgcgttagcgttgcggtatatccctgacgttcaaacgaatttccgccaaatcagcctagcgcagcaagctcgtggttatgagctgtcacctaaggcaaagctgtttcagcgactgaaaggcatggggcaaattttgctgccgctgatttttaccagtctcgatcgtattgatcagatcagtcaagcaatggaactgcgacgttttggtacaggcaagcggcggacgtggtacatggatcagccgttgcgcacgcctgactggatcgtgctggccggtgttgccgtgattatcgtcattggcctgtttctgtttcatgttaatggcggacggttttataatccgttccgaggatgatgtaaaaaaatatgaatattgcttcatcaaaaaagttcgatggtcgtttaacagatcaccgaactttttttatatgctgaagttgccttgaccaactgaagacagatgaagtagctgctaacgaacaatccctcattggcttcgatggcgctgagtcagtgttgaaggtgtatctcaatggcgatttcatcgggcatagcaagggtgcccgttaaccaagccattgaattgctacgaaacactactgatgccatcggggatattgccatcaaagtcgttttttcaagctacgtgcagtttgccaaagctttccaaaaagctagacaaatgtcaccgtctgcttttagaaaggctatttcaaatggtgagttgagtccacggaaaattgattaaaactagatgatcctactgagcaagcacgaaaacacccctcgttatggtttctcaatagcgaggggtgtttgttttgtcatgtgatcacgccacaaaaataaagtccttgagcagttgataaagcaaagcaatttcgtagtcctgcaccttgatattgaatttttgctcaactggctgaaaaatgccgctggaaagggagaaaaattcttgctcaggtggggttaaggttgcgcgatcaattgaagtagtgctgcgtttgctggtcatcatgcgttcaatcattaaggacaagtgcatgaagagattgagctttagtctggatccgaatttgacgttgtagaaatcttcgtagtgggagacaatgcgttgactttcttgaatgacaatatcgggattcaggatctgcaagcggccgcggataccttctatcgacaagaagcgaaccaatcgatcaatgagttcattaatggactggggactttcaccacaattgcgtaggacagtttgcattttttgtgaggaggccttatcgaaaacattatagacattcacgatatcaatgccgatatcggccccgatatcgccagcaacatcggtggtggttaagattaactgggtattcgagaaaaattttcgatcatgattggtgagcagggtatggagttctttgtagtcaacggcaatgacttcaagtgctggcgaaagggtcgcatcaattagctttttgacttcttcagacagaccgacgccagacatgcaagagacgataatgttcttcttgtttgataagccttcgtaatattgggcttcagttgttgcaccatattgctcgctggcttcagcgatggactggaaggcatcattacgctgaacgcgcaggccaatatcgagcgccatagcagtggttacgttgttgaccacaatcagttcttgatcagatacctttttaatttctctgaacatctggcgcaaagaacccatatcgaataagacaatattacccttagcagatggactttgatcggttaggtattcctgaacgtaaccgttgatttgatcaagtgtcacatcaatgggcatatcaaatgcctcaaaaaagtaattaccgcaaagcgaattcaccacttgctggatgctcgatgcggtgtgttcgccgtgagcaagcaggatggcattgtattgcactgattcgattttactttcgcaatgaatcatcatcatgaagaatggcagataatagtaagggctttgagcatactgcgcttttaacttagtcaaaaagtgcttgaaaaggtagtaacttcgaggataacggtgcttgattgctttttgaattttcagtgctgattgtgtgtctggcaagttgtcgcgacaaagacccgcgaatgcgaaggcaagtgccacattttgccagaaaatattgtcgcttggaaacgttacaccatatacatgcgtgatatacgttttagcgtctttttgaatggcctgcgcaaatacagatagaagtttttcactagcaatggtatcgacttgattgagcactttcgccagaagaaaattctgttcagtgatggactcaccattgtttagcgagtcagaaagtttcttaaaaagcgcatcagttgttgggccaagctgcaacgcgctggtgatcaaagatgtgattcttgcttgcaaggtctgttgtttaggcgttaccagaatcgcacttgtatcggtttgaccaagccgtagctgcgtgtggtcaggcgctttggcataggcgccagcgcaaagcaactgaacacggttattcaatgccgtgatgttattgacgtgatcaaaatttgccagtttgatcaactcgtttggtgcgatcaagatctctttattgatttgatcagcctgttgttgaaggtacatcgccgcaaacgtaatgcgctcgtttaaaggtcgatcgctaaaagcgcttagtttaatctgaaccgctgcacttttgaaccagacgcgcgctgctttgaaaatttcagttgttcctgaatagatgtaacgaaaagcagtggtttgttgctggttggtgtgcgtgaaaagatagtgttgatctgatgagcctagcatctgcacatttttaatatacaagtagccactttcggcggtgccatctgccgtcgttgcattgttctcactttgcaacttctttttgagtgtccctggatgatccttatagttggcacaatcaatgattttaaacacagctgttttcttaagcacttcacgacgaatggcttcgtgataaattgcctgagcaaatggcaacttgccactaccggctggaccagtgatgaagatcggcaatccatgtgttggatagacgattgcttcgattgccagctgaatgttagtgcttaaactaccgtggacaccgattaagtcgtcaaaagcggaatggtcccgcttgacttgccagtaaactggtctactgccggtcttgagcagtttgccttgcttttcgagcttagataaataactactggtcacgccgcgtgttagccccactgcatcggcagcctgattagttgtgattcgttcagttggaaagtgttgcacaattgtcgcataaagtttttctactgcgttcaaagaaaccaccccttaagcactattcccgcaaattaagcacaacgtcttcgtgacttttattagtaatgtgcttaacataatcattgtaagcgttaaccttgttgacgtccagatatagagagaaaacgacttacataacgattgcagaagggagggcgttcctcgcggggacaaccgcaatactgtccgaacaataatggatcactttcagttgtacttcggttgattgtcgccttttgcggtaaatccatattttcatagtcttgataaagggatgatttagatgaaatatttgcttcttgtcagtcacggtgatttctccagtggcttaaagcaaaccttgggtatgtttgcgggcgatgatgcgattggttctgtcattgcggttggtttaaaacccgatgaagcagcttcaacatttggaacacggtttgaggcattgctaaagaccctgccagaggatgcaagctttgttgttctggcagatattgtcggcggtagtccactcacaacggtttgcaacattttgaacgaccatggcaagctgcaagatacgcttgttcttggcgggatgaacttcccaatggcgttaaccacattgatgtcgaaagacagtttagataactcagcgttaaaagaaaaagcattttcagaagcaaccgcggccatcaaagaatttcagacgacctcatcagaagcttctgacgatgacgatatttaaggagtgagcaaaatggcaatttcgtttgtacgtattgatgatcgcatgattcatggcttgatcacggttcgttggggcaaggaatacccgatggatgggattattgcggtaaacgacaaagcggcaaacaatccgattttgaaggaagcctatatggcagcgtctgacaagaagaccttcgtttggacgttagatcattttgacaaggttaaggataaggtgttgaactcagcaaccaagtattttctcatcaccaagagtcctcaagatatgaaaaagatcttggtcgatatgaacttcaagccgggtgacattaaaacagttgttgtcggtccaggtaatgatcgcgacaacgcggtcaaactcggagacaatcagtcgtttacccaagaggaaggcgatgcctttgaagcgattgagaaggctggttataaagttgagtttgcgctgttgccagatcagcggattggtagttgggacaaattcaagtcacgctttgggtattaatggttgaacaataacgcgctcgcagttgcagaaacctgcacataaggaccttggtcgcaatgaccaaagagcagtcatcacgtccaaggctgcttatgttccggtttctaaacgcttctgctcgcgctcacaataacgcgctcgccagcgctgaagcctacgtgtaaggaccttggtcgcaatgaccaaagaacggtcatcacgcccaagaccgcttacactccggtttcacccgcgctggctcgcgctcacaaaaaaggaaggtaagaaaaatgacaattagttggtttcaagcagctattttaggtgttttcgcttgcttatgttccaactcatgtatggctggtcaagcggttggtaattataccattggccgtccattggttgggggtcttgtctgtggcattattctaggtaatcttcagttagggattgcctgcggggttgcgatgcagttggtttatatcgcattggttaccccaggtggtactgtttctgccgatgttcgtgctatttcttatattgggatccctctagcaatggttgcgatttcttcgcaaggattgaatccgctgggtggcggtgctgctaacttggctaagtcagttgggacattagtcggaactgtcgggacggttttgtactacgctgttgcaacaatgaacctggtttggcagtcctttggttggaaagacgttcataatggcaagcttgataaattaacagctgttaactttggctggccttggatctcacatgcattgttctcatttttaccaacaatgttactcacatactacggtgctacggcggttacagctttgcgtagtgccttaccaatggacggcattgccatgaagacactgttcacggtcggcggcatgctgccatgtgtcgggattgcgattctgcttcggcaaattgttggtaaagcagctgatttcattccgttcttagttgggttcacacttgctgcttcactacacttgaacttagtctcagtcacagttgtatcgttactgtttgcggttattatttatgaaattgagatgtctggttctaacaacacaccttcaaagggtagtgcagcaccagcagatggaccaagtgacgatgatgatgaggaggatatttgatcatggaaacgacaaatgacatgaaaaagcttgatcacaaaacactgacaaaatcttttcatcgttggttctggggtgcgttgacctgcttctcacaagaacatatgcagacttttgggtatatggcatcaatgctgccaattctcagaaaactgtatccaaaacatgatgaccaggtcaaagccattcacgcttacaccgcgttcttcaacaccaacccaatgctcgggaccgtgattgtggggatcacggccagcatggaacaggcgcgtgcgaacggtaaagaaattgacggcgagaccattaacgatatgcgtgctggcctgatgggcccaatcgctggtattggtgattcattgattgatgggacattgattcccattctcttagggatttcccttggtatgtcgactggtggttcaccagtcggggcgattttctacattgttgcctgggtattgatggcttactttggtcaacgtttcctttacttccgtggttatcgcttcggtgatcaagcggttagtttcttagttggtaaacaaggcgcggctgttcgtcacgctatcgggattgtcggcagtatggttgttggtggggttctggcatcatgggttaacgtcacaacatcactcaaattacgcggtgctgatggcaaagtcttcctgaatctgcaagacaagctgaacagcatctatcctggtttgctgacagtacttgtaacattattctgctggtggttgatggcgaagaagcatgtttcagctatctggaccatgctgctactcgttgttgtttcgctcgtcggtgttctagttggtttcttcaaccctggcctgtcttactaaactacgaacgtgtatggaagaaggaaaatcaaaatgacaattgacgaaatgactaagggatacgaaaaagaagttgcgtatcagaagcatatgttgaaaaacctaggctactggtttcaactttgcaccattctcagtggcgttggcattgttctgatctacttcttccatggcaagaccttgtggttaaacatcgttggcattgtgctcttagtcctgggtgcactggggatgttgatgttcgggtattcaggttggaaagggcagcagaatgttcgggcggtggttgacgactatgacaagaaaatcaaatattttcaaaagaaggttcgtcagcagacgggcattacgcccaaagccaaatagctcctgttgtaggtgactttaattgtagatacttcatttatcagtgataagtgcaactatggcaggactgagaagtcggtgagattcagttctcatcgactttttttgtcgtaaggctacttagcaaaatgtggtaaatggacagcggcaaccagaagatttcatgtatatgaaatgcgtcaaacaaataggaggatgaataaagttggaaatggatgaaaagaaacattacaagatgtataaaagcaagagtgtatgggtatttgcctgcttatcaacatgtcttatcgtttcattttttaatgacgggcaaaatgtaagcgctgctacaagtgcttcgtctacccaaattagtcaaacaaacactggtagtcagcctaataatgaaacgacaggtgagacggctcagtcttcagtcaatagtacggcaactgcatcatcatcaagtgtggctgatttgccgagttcgagcgacagcaagtcatcaattggtagtacaatcagtcaaccaactgttgataaaaaagagacttccaaaagcgatactgctgacaatgatttgacaaaatctgtaacaacgagtgattcagacaaagcgctccccacttcgaaaaccacgttgccgacaagtaatgaacaagtacaaagtagtgtgggacaatctcaaactgaccaatcagcatcgtccgcaacaattgcaaccaatgcagtcacctctgacgtcagtcaaaacgatcagtataatgaaccataccgaaaccagtatcactactcaagtagccagaattggatcaatgatcctaatggtcttttttatgatagcaagacggggctttacaatctgtattatcagtacaatccggaaggtaatcagtggggcaatatgtcttggggccacgccgtcagcaaggacttaattaattggacacaagaggacgttgccattccaatgctacagaatcaggggtgggaagactttacgtataccaacacaactggttcgctaaaagataaaggcgaagttagatatgttggtgtaccaacaacaaattggggtgacgctgacggcaaaaaggctattttcagtggctcgattgttgttgacactaacaatgtcagtggcttaggaaaagacgccattctggctttctacactgctgattatcagatcgcaactagaaaaaatgatggtgctgaagacggatgggggacctggattggtttaacagaaattcaggagcaacatttggcttacagcctcgatggtggcaaaacgtttattcaatattcgaaggatggtaatgcagctaatccccaggcaatcattccaaccagtatgaaccaaggaggagatgccgccaacttccgcgatccaagcgtggtctacgatgcggttaacaaacaatactatttgacagttgtgtctggtcagcaagccctcatttataaatctagcaatctgttggactggacatatgcttctaagattgaacgtgaaaatgatgttggtaatggcgtatgggaatgcccatcactggtaccgatgaaggtagctggaacaaatgaaacaaagtgggtcttttgcatcagtgtccaacaaggcgcacatgccacaggatctgggatgcaatattatgttggtaatatgacagccgacggaacttgggtacctgagagttcaaaaacgttgcaaaatccaatgacgatggattcaggagaggatttttatgcgggtattcctttctccaacatgcctgatggtcgaacggttatgttggcttggcagtcgaattggagttatgtggacgaggccaaaacttcaccttggtctggcaatatgacacttcctcgtgagctgagcctcaaaaagaatgctgatacaacagacgggtacttgctgacgaatactgtggtcaaagaaattgctaataacgaagaggccaatgttattaacaaggctgaaagtaactttacggtttcgcgttccgatgagcaagtccagtacgaaggcaaacaatataagataagtgcaactttttcttgggacgaagctgacaaaccgaaatcagttggctttaagttgcgagtatctgatgatcaaaaatatgacatgatcgttgggtatgatttaactacgggattattgtacgttcagagactcaataccggtgaacccaacatgggagcaccacgagacaaaatgaacgcaacagtgaatgcggatggatcaattacaattacggtttatgttgacgaaacaagtatcgaagcctttgcgaatgatggggaaaagtcaattacccaaaatttctttatgcggccggaaaatattggggaccaagccacaacaggcgtctatgtgtactcgaacgatggcacgacaaagatcagcgacttaactatcaatccaattacttcaatttggaacagtactggtcaactaactgaaaaatttgtagatgaaaatggaaacactatagccagtgataaaattcagaccggtcgtgtaggacaaagctacacttctgagtcagcaacgattccgggctatgtttttgtaaaagaaaatactgaccatattaatagcaaccagttgtatacgacccagaatcaaacgattacttatacctatcgtgcgtctcaagcgtctgttgtaaccaaggatacaacgttagcagcaggcccatcagccgcttggaacgcggccgataatttagtaggcgctacagacgcagacggcaatgctttggctgtgtctgatttaactgtcaacggtgcagtagatccaaagacaccgggaacttatacggtaacgtatagttacaccgatgcgacaggcaacaaaattagtaaaaaagccacagtgacagtcatcgcgtccaaggctgatattgtgactaaagatacaacaatggtcgcaggagcatcgactatttggaacgcggctgataattttgtggaggctaagaacgcagatggcaatgctttgactgtttccgatttaatgatcaatggaacagtagattcaaagacgccgggaacttatacggtaacgtatagttacaccgatgcagcaggcaacaaaattaataaggaagccatcgtgacagtcatcgcgtccaaggctgatattgtgactaaagatacaacaatggttgcaggcccatcagccgcttggaacgcggtcgataactttgttgaggctacaggcgcagatggcaatgctttggccctttctgatttaaccgtcaacggtgcagtagatccaaagacgccgggaacttatacggtaacgtatagctacaccgatccagcaggcaacaaaattagtaaggaagccaccgtgacagtcatcgcgtccaaggctgatattgtgactaaagatacgacaatggtcgcgggtccatcagcaacatggaacgcggtcgataactttgttgaggctacaggcgcagatggcaatgctttggccctttctgatttaaccgtcaacggtgcagtagatccaaagacaccgggaacttatacggtaacgtatagttacaccgatgtagcaggcaacaaaattagtaaggaagccatcgtgacagtcatcgcgtccaaggctgatattgtgactaaagatacaacaaaggttgcaggcccatcagcaacatggaacgcggctgataatttagttatcgctacagatgcaaagggcaatgctctggccctttctaatttaaccgtcaccggatcagtagattcaaagacaccgggaacttatacggtaacgtatagttacaccgatgcagcaggcaacaaaattagtaaggaagccaccgtgacagtcatcgcgtccaaggctgatattgtgactaaagatacaacaaaggttgcaggtccatcagccgcttggaacgcggccaataatttagttagcgcaacagacgcagatggcaatgctttggccatgtctaatttaaccgttaccggtacagtagatctaaagacgcagggaacttataccgttacgtacacttatacggatgttgctggtaacaagatcagcaaagaagccacagtgacggttttaacagaaaaagagacaaacattgaagacaataccggatccagcatttctaacgatcgcgagaattcccctgcttcgattactggcaaaggcggagacgacatacatcaaaacgcaaagacaacaatgaccaaaaagaaaaccgagacattgccacaagctgggaatcacgtcaatgagttagcgattgttcttggacaaatgatcttagcaatttgcgtaggaggtattttatggttaaagaggcgggtgaagcgagtctaaaataatcaagtgattatctgatacggtcagatcgcttgtagatctaaaaactcaaggatttatctggcactgacaggataaactaagagacatagctggccattttgcaaaagcgaatgctatactaaagacagcaaaaagccgttgtgcgctaacacaacggccgggcaaatgcccttgcagagccagctaacaagcagtggcacgcaggattaggcaactaacagccgcgaaacccgtgtgaaggaagcgcggcttttagtttgcctatttttctcgaaatgcttcgagcgcctgtatgagttcgtgaactgctagaagcagcttggtcgttgctgacaattcagaggtttatccgtcattaggtaggataaaaactgaaagatacaactagccattttccagaagagcatgctatactaaagacagcaaaagccgttgtgctcgaacacaacggccggacaaatgtccttgcagagccatcaaacaaacggtggcacacagaattaggcaaccaaaagtcgcgacattccggtgaaggttggcgcggcttttagtttgcctatttttctcgaaatgcttcgagcgcctgcataagttcgtgaactgctagaagcagcatggtcgttgctttgatcaatcgtgtgaacacgatgatcagcactaccaatgaacatacacaggctgtgatcgttgtgatgatagcgatcaccggcaaaacatgacacctttcttttaaaagtgtgggttataggaactagtcccataggcaccacctactttccgaatcaggcaccaccgctcattatccttctctgctggcttcagtttatcagagtcacttccagcgtgacgaccttgcgtagaacaacgaatgttatatcgtgctttttaaatttattgagaaacgctcagtcactgagcatatacgtcttaatattgataactttttgatggattatttttctctatgaaatttgatgaacgttaataacaagcagccaaaacaaatttttgcaacccaaaaacgacgatctttgcggatcgtcgttttttgattgcgtctgacaggggaatcaactaggcggcgtgggaggtcggtagtctgattgaaggggctaccgttacccgattattgcaactgttcttgatttaagtgaaaaaattcaagggcttcatcatagttgctaaaagatgccgtgaccaagtcgaaaatatcagcatctatcgggactggattttcaatgcgataaaccgctaagcctgcgtttttagcggataaaatgccgttcttagaatcttcaaaagcgacaacttcatccggtgggaaaccggatttggcgatggcctgcagatagatttcgggatcaggcttgccatgttgcgtctcgtcgccgaacaaggcgaattgaaaatagctagctaaatcgagcttttctaaaatcgcctgggtttcgtttcgataagaggaagtgaccaagccacaactgatttggtggtggccgcaagctttaaggaaggcacgcgtacctaggatgagttcaaaattgccgtgctgaaccagcgctgttcgctgtttcaaaaaggccgaaaagagtgtatcaaacggaaagcctgtcccatagtggtccgtgaaagtttgttgaataccgctcatgggcatgccaagaatgtgacgataaaaatcaaccgtaagatgatagccattatcggctagtaactggtcccagatggcatagtatttggcttcagagttaatcagtgtcccatccatgtcaaagagaatacatcgcacagaccaacgacctcctttttagctgaacttaacctgatcagaccgtgacaacttctgtttgcgccgtcagctgatctttaattttggcaggtaagctgttgtcagtgattaagtaatcaatatcatgccaatttgcatactgggaaagtgatgaggaactagcttttgaactgtccgctaagacgaagttcagtcgactgttttgaatgatcttgtgtttaatttcgacatcgtcaagactgtttgaacttggaccattgtgctcagcgaagccggatgtgcctaagaatgccatgtccatcctgattttttcgatgaagccgagtgtttgtgtgcccattgtcgcaaacgtcaaaggatcgaccgagccgccaacactgatgagatgattttgactggtcacgagttcattcacaacaggcatggagtttgtgatgatcgtatggccagccgtttcttttaacagacttgcaaaggtcagcgccgtgctgccggcatcaataaaaatagttgagcgctgggaaacataggacagcgcttttttgcagatggccagtttttgttcgtgaaaactggccattctttgttcaactggcggaatattgaaatcctgaacgggcatcactgcaccgtaccatttcttgacggcaccagaatcgtcgagttcctgcagatcgcgccgaattgtttcgcgagatacgttgaaataagtggctaactcggtgatcttcatggttccttgatgtgagatcagatcaacgagctgtttttgtctgtcaatggcacttaattttgccatggctaatcaccttctcgctttcgattgtagcaaatacaacgcaacaacgccacgatttgttgattattaaacataaaatgtggcaatttaaacattttatgttgcaagatacacattagccggctatactgaacttgtcaaaaggaatatcagccttgaggaggagaattcttatgaagttgcaacttgcattagacgatatctcgcttgtagatgcgttggttctggccgaaaaagttcgagactatgtcgacatttttgaaattggctccccgtttatcatccaagaagggatgcgcgccgttcgcgaatttcggcgttattttccgaaaaaaaagatcctggccgataccaagattatggatgcaggcgagtatgaagctgagcttacctttaaagctggtgcggactactgcacagttctcggtgtgacggacatcttgacgatcaaagcttgtcttgctgcggcaaagaaatatggcaagcaagtctttgttgatacgatctgtgtgcctgacttgaacacccgcatcaaggaacttgaggatgttggggttgatagcatcagtgttcatgttggcgttgatgagcaagcggtggggcaaacacctttgaatgcattgaagcaagttaaacaactgagtaagcactcacagctgtcagtcgcaggcggcattaaagtcagcacggttgaccagtatcaggcccttggcgcagatatcattattgttggcggcggggtgaatcatgccgacgatcctgtcgcaacagcgaaggctttggccgacaaaattcattcgcatgaaaatgtaagcgcttaataaggaggaatgatcatggaagcaaaaagtttgaagacaattatcagcgaactggatcaatatgcgccaatgattgatgacacccaagtcgaaactgttgccaagatggcttttcaagcaaatcggatttttgtcggcggtgcaggccgctctggttttgcaggtcgcggttttgctatgcggctcatgcatttgggattgcacgcctattttgtcggggaaaccacgaccccatcaattggggaaggcgacctacttgtgatcggttctggttccggatcgacaggcagcttggtggttgatgctaagaaggcaaaagcggtgggcgctaaattggcaacggtgacgatttatccaacagccgaaatcggcagtctggccgatgcgatcattgcgattcctggcgaaacgcctaaaaacgaaacaggggcagccgacactgctcattcggtgcaaccaatggggaccttgtttgaacagctcagttggttaacttatgacgccattattttggaattaatgaaattaactggcgagacgacggacacgatgtttcctcgtcacgctaatttggaataggccacttaaactgatgccatgacttgtttggaatcgtgaatagttaaaagcgctagcaattggacaactgtccaaggctagcgcttttaatatgaaatgtttgacggtattaatctaacattactctttttgtgcatgactaagtggcacgatctcaacctctctatcctggaattgttgcatcaaggacttgtcagtcgaattcgttactagatagtcgatttgcggtgtctctgcagcaacaaaatgacttcgcatgccgactttatccgcggttgcgatcgcaatggtgatgtctgaactgttaaccatttgatttttaacttgggcttccatttgctcaacaaaggtgacgccgagatgtgggtcaatattgtagatacccatgacgtaggcgtcagcatgcagactagtcaacgcattaatcgtttcggcacccagacttgattcagctcgttttgacactaagccacccaacgcaatggttgtgatattgcgcttgtttgaggtttcaacggcgataaggggactattagtgatgatggttgctgtgaaatctggtggcaggttttgaactaaccgtaaattggttgtgctgccatcaatgattagaacaccattttcaggtaatagtggaattgcttgtttaaccaaggcaatttttgtctcggtgtcaaccttcatgcgatgctcaaaattggtcacatccgggccattactgatggcaccgctttgaaccctcagaaggagacctttttgatccatctgacgaagatcgcggcggatagtatcttctgatacatcgaatgcttggactaagtctgatatagtcactgccttattagcactgttcagtatgccgagaatgcgttcttggcgctctttttttaacacaatcattcacctagattcattgacaacttattttttggcgctctctgatttcgattatataggagcaaatctacaaagacaaattagtctttgaccaatacttgcaaaagttatagggatatttgcatataaaacgcaaaaattacttgatatatgcaaaaaaagcggttacactacagttgcaatcagaaattataaatgaggagtgtgtggtatgacagaatcatggcttgatttatcagagaaggtcgtcgttgtcactggcggtagtatgggattgggcgaaaagatggttgatggtttagctgcgaacggcgctcaggtcatttccgcggatgttgtcgaaaatgatagtcacgcgaatcaaaagaatgttgtgaaaatgatttgtgacgttaccagcaaaacatcagttgaaaagatggttcaagaagttattaaacaattcgggcatctggatgtcttaatcaacaacgctggtgtgagtcgtccgcgaatgttagttgattattatggtaaacatcctgagtacgagttaagtgaagaagacttcgatttcatgaccactgtgaaccaaaaaggcgtctttctctgcacacaagcggtagctcgcgagatggtcaagcagaaacatggtgtcattatcagtatgtcttcagaagctggattagatggctcaaagggtcagagctgctattcgggaaacaaagcagcggttagtgcgttcacacaggcatgggcaaaagaattaggtcaattcaatattcgtgtggtagcagttgcgccaagtattaatgaacgaacacccatgaataatgatgccacttttaaagccttggcctacacacgcgggcaagacccaaataatgtgtcagatgactatgcatctaaaattcctttgggtcgtccaggtcagctgacagaaattgccgatctcatttcatatttagcatcagatcatgcttcatatatttccggtaccacgattaacatttccggtgcaaagtcgaccagataattaaatctggctggtgcgttccttgagtgaaagcttttaggacgttaaaggaggataacaagatggaggcctcaggagttccgcaaaaaaggttgatgtcttagctagaatcaggaaatttggcggctatatgagcggtatggtgatgccaaatttgggagcatttgttggttggggcttgatggcagcattgtttattccaaatggttggtttccaaatgcagatttaaatcatctgattaaaccgactttggactatgtattcccaatgttgataggatataccgctggctataacattcatggtcaacgaggcggcgtcattgggttgtttgctacgttgggtgtcattgtcggggctgatattaccatgatcagtggcgcaatgatcatggggccgttagcagcatggctattaaaaaagtttgataactgggttgatggaaaagttcgaccaggcttcgaaatgtttgttgataatttctcgttagggattatcggcgccgttcttactattttagcttatatttcgattggtcctgcaattcagtttttagtagcagttctgtcgagtggtgttacttgggcaaccacccataagtttattccattgctatcggttttcatggcacctgcacaagtactgtttctgaataacgtggttaatcatggtattttagcgccgattggctatgcacaggcagctgaagccggtaagtcaattatgttcttagttgacaccaataatgggccgttactgggaactttatttgcaattgctttggcaggtcgaggcaaggcaaaaaatactgcaccaatggcaatgttcatcgctggaattgctggtatcggcgaagtctacttcccattcgtattggcaaatcctatcttagtatttgccacaatgggcggattggcagtttctttattcctgcaagtattaatgggcggcggtttgattggagtcgcctcgccaggtagtttgataaatattgcaatcatgacacccaaagatgccattgtagccaattttgtatcgattttagcgggtttcatagtttcaacactcatagcgttgttcttactaaagacattcgcaggcggtaaagatgatgatctggaggaatttaatgttggtggtcgtcaagttaaatcagttgctaattttgtgccagctgtcggcgagaccattgccaaaacaacctctaagattaaaaagatcattgttgcgtgtgattctgggatgggatcaagtgcgatgggtgcgtcggtattgaagaatattctgaaaaaatcgggttatgcagatatttcggttgaacattcttctgctaatcaaattgcgccagatgcagatcttgtgatcactttagattcactaattgagcgagcaaaacttgccggtggttcggatagtattagttatctgccagttaataattttttaaaggaagatgactacaaacctgcaatcgattttattgcttcacgtaatcaggcaacagccactaaaactgaagtagatgatccagatgatttggtgcctacgaaaaacgaagctaaagtcttaccgaaggaaaacattaagcttcatcagcattttcgaacacctgaggaggccattgaagccgctggtcaggtccttgctagtaatggattcgttgataccacttatatcgacgacatgctgaaacgaaatgaagatctctcagtgtatgttggtaatcatgttgcggtcccgcatgggttggaaacctctgatccgaagattaaaaagtctggattatccgttctgcaagttcctgaaggtgttgagtttggaccagatgagattgcttacgtcattattgggattgctggtaaaagtgatactcatttagagatgcttaccaaaatttcacttgtactgatggatgaagctaatgttgaaaagatccgatccgcagagagcgaagaggaaatcatggcagttttgaacatttcctgatgatatgaacgagcagaaaagcttatatattgacacattcgaaacatgactaattaatgcggtgatacgggaggaacgatcatgaaaaatgtactcatagttggcgcaggacgtttaggcaaagggtttgttggcgaaaccttctttaatgcaggctggcacatcacgtttttggacaaagatccgcgggtgattgatgagctgaataagacaaaaacttacgatgtgacagttcacacaacagaagaagtttttacgcatactatcagtaacttcgatgcttatttaattgacgaccaacaatcagtgatcgacagttttttaaaaactgatttggtgatgttaccgctatatccagttgactttgaggatgcagcaaaggctttagcgataggattcaatcgacaatatgaactggatcccagcgcgaaaaaaacattgatttgtctgacaaacaggaatcatattattgaccgtattaccaactatttccgggacagtcttgctaatgatgatgttcgtgcatggttcgatcaaaacgttgtcgtgcgtgattcaattgttcggcgatcaactgatgctgtcaccgcctatgcaactcatattgagacaaccgcagtttcttcgctgattattgaaggaccagtttacagtgacttctcagacgtaaaatggttagatgtccgtaaaaatgttgaaatgcttaaagatataaaagtctttttgatcaatggcccacatgcaacaactgcctattatggtcattggcgtggtcatgagaatattccagatgcagaggaagatcctgaagtggagaaactcgtcaatggggtacatgatgccacggttcaggcggtactctatgaatatcctgtcacgcgtgacgacattcgagaattggagttccttccagcagccaaagatgagatggttgattccatctttagagttgcatatgatccaattcgaaagacaagcccgcatgaccggttcatgggcgtcattgatctttgcctcaagtacgacattgactatgcgcccatcaccaaagctctggcaacagcatttgcctatgttgagtcgagagatccgaatgccgttaaaattcagaaggatattcagaagaatggtattcgaccaactgtttcaaagtatatcggacgtccagaagatgatgtcgtggttgaccgggtggttaataactacaagcaattgcaacaggaagcgacagcatcagttatgacaccgggagcttaattgaaaaattcattttttgatgcagctgttgattacttggtaaaaataatgcgctactatcataacgttctgtttgctcgatagtatggactataagtgtattagataattagaaggcggcctcgtcattcctaaattataaaggagtgtcgaggtcgccttttccagttgtatgtagagcaatggtagaagggtatcaaaatgattttgttatcttcttttttgcgtcagacaagcagttttatggaaaatgataattattgcggtcttgcaatgctgtagcaactttattagcgatttactgcagtgatgaaagattatgaggcgtcagttggaggagtgactatattgagtatccctcccactgtgcaatagcaagaataatcggtttcagtgccatcccctccgccgttaaatgataagttgtgacgagtggctgggttgttagaatatgtttttgaatgaagccatctgcgcatagttgcgcaagttgacgagcgagcatccgagttggacaaggggagacgctggcgtttagttctccgaaatgccagtttgattgctggataaaacgatacaggataattcctttccatttgccggaaattttttgaagcaggcgggttgcgggacaaggttgattttgggttgaagaacaagaaggcatcatatgccgactcctttcaaaagtagtgacaaaaagtgcagtattgcgatttcatagcatcgattataccattgacaaatagtaagcaaccatgatttctgagatcagagattttgtgctttttcatttgtatcacgcgactttttatttagaaaggatgtttttaatttgaatcagttatcgcatactcagtatcgtcactccacgcgtttgttcaccgatcaggtcattgaccttgcaacactagagaacattattcgtacggccagtcatgcaccttcttgggagaatgcgcaaccgtggaaagtttatcttgcaacgggtgataccgtgaagcaaattcgtgcgagtcatgaaaaggcagtacaagataaggctaagagttggacagaagtcacacctccactagattggaagcctgatcaacagaagaatattgaacattggcaaacagctcttggtgattttttcaattctgacgaactacaggcttttcacacggctggcaaaaagctttatcatgctgccgctattgtttacatcaccattccaaagaatgcatcggcctatttagcatatgatgcaggtgcttttggttatggcgtgcttttggcagcaaaggatgcaggcattggcacgatcccagcttatgagatgattcggtatccagatgaaattcgtgcacacttcgatattagcagtgacgaggcgttgttgatgggaatcgcccttgggtacccggcttctagcaagattaatgatcttaaaacagatcgacgaccattgaaagactttttacagatcaaggattgagcgttaatactacttttcagagaatttcatttgaactttttgaaacaacgctttttacccaaagacacctgcgacagtgagaaaattcctgttgcaggtgtcttttttttgtcgtcttcaactggttaatcccactcagcatgcatcgtctcagtcattcgccaataaacaatcagactaataagcgcacatagcgaaacataaatgaagaagtaattttcgtgatgtgcttgcttgaaccatagtgcgatgtactcagttgttccgccaaacaaggcgacggtcaggccgtacggaaaaccaacgccgagtgcacgaatttcggttggaaataactccgctttcacaatcgcattgatggatgtatagccagtgacaagaatgaggccgactaacattagcaggaatgccatcaatggggttttggtggtttgcatcagccaaaatagtgggaccgtcaagaccgtgctgccgatcccgaaaaagaagagcaaggggcgtcggccgatgtgatcggatatgtaacccgccaaaggttgaaggcacatgaagatgaagagggcggcgaagttgattaacgccacggttcctttgggcaagccaaccgaattgatcatgaatttttgcatgtaagttgtgtaagtatagaagcagatagtgccgccgagcgtcaggccaaccacggtcaggatttgcttgggatacttaagtaaggcgcgtatcgtgccagctgattggcgttgactggtggacatgtgctgaaactggtttgactcgtccatcgatagtcgcagccagagaacgagtagagcaccggctgcaccgatggcaaatgggatgcgccaaccccaggagctgagttctgtttcagtcaagtacatctgcaggataatctgaaccccaagtgcgatcaattggccgctgactaaggtgacgtattgaaaacttgaataaaagccgcggcgtgaaggctcggccatttctgacaggtaagtagcgcttgtcccgtattcaccgccaagcgacaggccttgaaacagccgaatgaccactaacaaaacaggtgcccaaataccaactgtctgataatttggcaataaggcaattaacagcgacccgctggccatgattaggatggataaggtcaacccggcccggcgcccgtggcgatcagcataccggcccatcacaaggctaccaatcggccgcatcagaaatccaagtgcgaatactgccgcagcatccaacagttcactcgttggatcatgacttggaaaaaacgaggggctgaagtagatagcaaacgcggcgtaaacgtaccagtcgtaccactcaatcatattgccgagcgatcctttaaaaatattggatgcgatcttgcgcgaaggctgcatggtcaatccccctatgatgtgaagttgccggacaagctgtttttactaatggaaaaaatgtacgcttttttcaaatgtttatctatctcttatgtaacattaattaacaactgtgaaatttcgtggttttcaggctgacttgacgatcaatacgatactggtggatgcgcgataggaagattttggccgatcgcgttttttgatgtttttttcctccgcaattatcgtgtcgcgcgctaatggttaagcgatcttttggggattctgcgctagtgcagacatatcgctttgattggtcagcgttttggttacttgattgcgatcacgacaactaactcgctgcccgcataaactaaacccatcgatatcgaaagacactaggcgccggatgggattaggagatggcacaggaggaggcaggatttgcattgtatctcgcacatcaaggggtggtgtatgcagctttggcgcagttggggattcggcgtgatcgaagtgattttcaggattggcgtgatgatgggatgttggtgtacctcaactacttcaaccgatattgcgatccattgacggatgaggccgccattcgcaagtttaataagctggcatggcattttgtttatctgacgttgatgcagcgaatgcagaaaaaccggcagcgaagcgtgattgagcggttgccaagcaatatcactttattgcagaaaacgacttttgccagcactgttttgaatgtgcagacatcgctggaatgggatggtcagctgcaacgactcgcggctattttgacgcctatggagcgaacagttttgggcttgcgattggctgacttgtcagatgctggcatcgcaggtcgattacagattagtcggcaacgagttttgaagatacgtaagcagttgcaggccaagtatcggcaggtggtcggataatgatcgtgcgttttcggtgagcagtgactaacgcgctctcagttgcaaaaacctgaacataaggacctcggccacaatgaccaaagagcggtcatgacgccaaaggccgcttataagccggctgctaagcgcgttgaagaccgctcactttttaggaggaataaaaaatggataaggaattattgacgtatgtcttagatcaggcggttggcgttgtgattgccgtgtttttactgacgcggattgagcggcggttggatgtcctgattacgagtattgagaaattcatgacaaagttggatgccaaggacaggttgtaggaggggcgagatggcgatattaatggcagatgtgagtagttggcagccggaatcggacagctggtttcgcaagctggcggatgttggggtgaaggcggtggtggtaaagctgacggaaggcaccacctaccgcaatcctaaggccgcagcgcaattggcggcaggtcggcgaatggggatgcaggtgcatggttatcattacgcgcattatcacaacagcgctgatgccgtggcggaaggacggttcttcggaaccacagccaaggctttaggtttgtcaaccgagtcggtaatggcagcagatgtggaggatccgggtttatctggtgagttgacgggggtgacgaatgtttttctccaaactgtcaaagcgatcggatatcctcacacggatctatataccatggccagttggctgaccgcgcggcgctttgatcgggttgccttgattccgaaaaatctgtggcttgccagttacggcgtgaatcaaccgggcgttgataatgtcggcacatggcagttcacgaataactttcaagggctaggtgttgatatgagttacgacttttttggtcactatacgacgcgtctcactggcacactcaacggtggtgtcgcgcgcgtgccaacgattcggtttcataccgtgcagccaggggagagctggtgggcgattgcgcaccagtacggacatgacatggacaagctggctgcattgaatggcaagacgattttgagtgtgattcaccctggggatcagctgcgggtggaataaggtttgaagtgaaaacgagagttgtctttcggctacttgcagaaggacaactctttttgtggtatgaatgtcccataaagacttctgttaacatatctaaagtctaatgacgaatacaattacggagagcaaagtcgggtataagaaatgccaaaaaaataacaaatttttataacgatctttaatgcttattaaaacgttcagtcagttgaaatttactcatgaatttaacgagaaacttttaatttagacgatgagtggtagtggctaactgtgagtataaatgaacgatgttttttaatgcgatttcctctcatgttaatttgttatagttcgatattaaataaaagcattagacagtaggagatagagtacttatgctgaagataacatccagcgagctaggacctcatagtcatgtgcttgagaaataataccgcggttgtttccttgatgctgattcaacggaagctgagtgtttttggtcaaatctttagtagacgaaacaaaactaggcggatagcaaaggagaacgcttatgataaaagacaaagttgttgtgattacaggtgcatctagtggtatcggtgctgaaactgctaaattgctcgcgagtcgaggagccaaggttgttcttggtgctcgccgtaaagagaagttagaaaaactgactgatgaaattagaaatcaagggggccaatcaatttatcaagtaaccgatgttgtcaaaccagaggacagtaaaaatcttgttcagcttgctaaaaaaacattcggtggtattgatgtgatgtttcttaatgctggcttaatgcccagttcaccactttccgctctaaaaacaaatgagtggaatcaaattgtcgatgttaacttaaagggcgttttgaacgggattgcagcagccctaccattttttaaagcgcaacgatcgggacactttattgcaacgagttcagtagccggtcttaaagcctacccagataatgcggtttacggggcaacaaagtgggcagtgcgtgagcttatggaagtgttacgaatggaatcggcacaagaaggcagtcatatccggactgccactatctatccagcggccattaaaactgagttgttaaatacgattactgacgaagctagtgcccaagagctgaagaaaacttacgatacttacgaaattacgcctgatcgaattgctaaggttgttgaatttgcaattgatatgcccgaagacacaaacgttagtgagcttacagtgggacctacaattcaaccttggtagtatcatagatgactttcccccttaaaaacggctttgagtatttttaacagcagatccgtatttgtcttgcttggtagggttggcagaagtgcaaaatggagtgtcgattttcatgaagaaaatattatttgtgattttattgctagttgcggtcgaattgacgggttgtggtaatcaaaggggaaagatttctaatggcaagtcttccgagatgccttcaacaaaagcagtgaagaaaatgacgagtaacaataattttggtcgatcattagtcgtgtattattcgttaacatcgcacacaaaacaggttgcagagtcgattcatcaccgcgttggtggtgatattgtggcaattcagacagaaaaatcatatccaacgacctattcagcaacaaccgctgaggtgaaaaaggagattaggcaaaaccaattaccccaattgaagacagctgacattgattggcatcaatataaaaccattttcgttgggtcaccagtgtggtacggaaacttgtctttgcccatgcaacagcttttccgccaacaccagtttcaatcagggatacacatagcgccattttttacaagcgggagcagctcgccgaaagaggcattcaccacaatgaagcgattgcaggcacagccaagttatcatcagccattgggaatcacaaatgatgaacaatctgatcgcaacagattagtggatcaatggctaaaaggtattaagttcgattaaagagagaacgagcaagcatatactattggtgtacaaagttcctttgcatcggacacagaaaaataaagcagaaaccgcctattggttcaaagaggcggtttttttgctggctatttgatttagaagttaaaaatgaccatttcaataaaaattcacaaaaagattgtgcaaaatatgttgacacggtgtcactttccgtataaactacaaattatcaattagtgacaccgtgtcaccacagggggcaatcatggcatctactacttttcaacatctagatgcagctaaacaacaacgggtcttagctgcactcatcacagaattttctcaatatccgttagcgcaggcgcaggtggcgcgcatcgtgaagcaggctgatattgcccgcggtgctttttataagtacttcacggatctagatgacgcctatcgctatgcctttggacgggtgatcgggcggttgcatgcgggtatcacgggtccgaccatgcggcaagatccatatacggcaacagctgattttctgcatgaggctagtgagagtcgtgaccgggatttcatccgcttgcatttcactaaaaatagcgggctggtgaatgtggcccggccacaagttcccgcagatgcaaccgactgggctgtcgcgtcgttatgccacagtgcgatttctgaggtactggctgatccggctgacgcgaccttgattttggcacatttgaaggcagcactttctcagctgcaagttaaggagtgaaacaatgtatctttcattaaaagaaatctggcatgaaaaattacgctatggcttgatcatcggtatgattttgctggtgacttaccttgtatttattctcagtgcgttggctaatgggcttgcccagcagaatacgcaagcaatcgagtcctgggacacatcgaaggtggtattggcaaaggactcggatatcaatttgagccagtcgctgctgacgtcagagcagacaaaagcgattaagctaggcaagtcgcaagcctatgtcggtacaatcggcgcggttgcgaccagcagcaagcactcggaaattcgttcaacgatggtcgggcttgattggaatcagtacatcggcaaggacatgcagctggtgagcggtcatcgcgtgcaaagtgacaatcaaattgtcgtggatacacaatttaaaaatgaaggctacaagcttggcgacaaggtgcggctaaccacaaacggccagcaatataccatcgtcggtttcacggaaaatgccaaaatgagtgtcgccccggttgtctacggcaccatggcgacatggcgaaaactgcacaacttgccggatacttttacggctagcggcattatttccaagtcggctgattttaaagttaacaacagcgatttgaaaacctatacagcggatacatttatccagaagctgccgggttattcagcccaaaatagcacgtttgcgttcatgattggttttctatttgtgatttcgctgattgtcatcgcggtcttcctgtacattttgaccatgcagaagattcctaactacgccgttttacgggcacaaggtgtaccggcgcggaccctcgttaaaacgaccattgcgcaagcactcatgcttgtgtcattcggtctgatcctcggtggggtgctgacggcagttacagcgcggttcatgcctctgggtgtgccgatgattttctccgccggtttaagcatcgcagttgttattggcattttgctcaccggcttactcggtgcaattgtcccagtccggacgattcttaaagttgatcctgtcacagccattggaggttgattgtatgtcagctatcgaattacaacacatcattaaaaattttaaaacgcctaccagcgatgtcgaagtcctcaaagacgttagcttcagtgccgaacccggcagtctttcgctggtgcttgggccgtctggttcaggaaaaagtacgtttttgaccattgcaggtggcattcaaaccccaacatcaggggtcgtgacaaccgccggacaggagcttgataagttatccggcaaggcgcgtgatgcattgcggttggataagatcggatttgttcttcagtcatacaacctcgtcccatatttgacggttggcgagcagttcactttagtcgacaagattaagccaaaaaacaacctcagtcatgaggaacttgatcaattgctggatgatctcggtattggtgacctagttaatcaatatccggcttccttatccggcggccaaacacaacgggtagcaattgcacgagccttgtatcccgatccagccatcgtgttggccgacgaaccaaccgccgcattggatagtccgcgtgtggcagttgtcggacagctgctagctgatctggcacataagcgtggtaaggcaattgttgttgtcacccatgatgttcgcttagaaaagtttgcggatcgcacgtttactttgttggatggtcagttaagcgaaggtgacacttccaacgcagcatagtgaaaaacaactggttgctacagtatgattaacgcggtagatgcttaaagagccctcttgtgtcagaattctgacacaagagggctctttttgaagcttaatcgtttatctggctgattgaaatgaagacatcatttgcctaatgtctttttaaaagtaattagaatcgcggttcgcctaaagcgtgttgcgcagccaagttcagcaagctccattgacgatcaaaacctggctggaagaagaagtcggcttcagccaagtcttcaaggcttaattgttgttgaacggcgagtgccaagacgttgccttgtgcagtcacgtcgtaagtggacaatactgcaccgcctaacagtcgatgagtttgcgggtcaaagactaagttgacgcaaacctgtggattgccgttagcttctggcacatagtctggccgcagtgaatcggtgtagaaagcggtatgcacgttaacgtcagcccgtttagctgtgaaggtgttcaggccgctagctgcaaaatggtagtcgaaaacgctcaacgcactggaaccaacgacgcccttgaatggccgtgctggattttctgcaaaaatgttttcggcaaggtaacgggcttcacgtcgcgcaacggttgccaaggcaatcggcaccttttgttgtgctggaattgagtaaaccaaagtggcatcaccgatagcataaacgtctggcaaattggtccgcagataaggatcggtgttgatgaagccgcgtttatcaaggttaacggtgcccttgagccattccgttgctggcttgatacccgctgcttgaatcacgagatcggttttaacgtcaccggcatccgttttgacggcgctaacagcttcatcgcctgtgaaggcttcgatcttgacaccaagcttgagctcaacacctttatcagtgagttccttggccagaatgtcggtcatttctggatccagataggtacccagtgggcgatcaatcatatccaacaacgttacttgtttaccagctttacgactggcttcagccgcttcaatcccgatataaccggcaccgatgatggtgacgtgcttaaccgccggatcttctaacttggccttgatgttggtggcccaatcgtagccacgcatcaagaagacattcttcaaatcgttgcctggcactggtaaggaattcgggcgaacgcctgaactcagaattaatttgtcataaggataatcctgcgtcgtgccgttcttcgtgtcgcgaacggtgacggatttcacatcagcattgattgccgtcacttcatggttgtttaacacatgtgcgccgcgcttgatcaaatcgtctggacgaaaattccgaacatcattcacatcggttacttgattttctaagaatagttccatcccgcaggacatgaacgaaacaaaatcacctgcttcaaacatcgtaatgtctgcatctggataacgatgcaacagttctaagacgctttggtgaccgccgtgtgatgcccctacaacaatgatctttggcttgtccacaaaaattcctcctaattatgtagtaaccgcgacttttcgtcatcggctctatctctatattagaatagttccaatctatagtcaatgatagacgacaattaattattgaacaatttatttttagagacggctaactttatgcagatgagctttggccacgacgctgcctaacagggatcgtggcaactatcatgttcaaaaaggtggcatcgcgcacgtttttttgtagaacatttttacccagtcaaaagcaatctcgttgatggttcacaaagacatgaaaaaagccgctgcactaagattcaatatctcagttgcagcgaccattcatttgcttattgaaatctcatggcgtcctgacggttagataatcgcgaagtgcttaagtgccttcaccacgccatcttcatcattgcttgctgtaataaaatcagcacgttttttgacaatgtcctggccgttagccatagcaacacttgtcccggcgaaatcgaacatatcgagatcgttatgttcatcgccaaacgcaatgacatcgtctgctgaaaatccgaggtgttgcgtgagttgcgctaggccccagcccttatcgacgccatggggcatgatttccagcataaatggcatactgcgaatgacggtaaaacgattgccaaattcagtttcagcttggggttgaatcgcggcaagcttatctggttcgcccagtaacatgccctttgcaatcacgaagtcttctggcatttcttgcggttcacggaccttaataccggccgtattttcccatgcttgtaaaacggtgtaacgactgatattgcgatctgccgtataaacctctccggctggcgtcaagacgttgctgtcaatgccgttgctagcgaccgaagccgcaaaagtcgaaaagtcttggtaatcctgatgattcagaaacttttcagcaatgattttgccactcgcgctctgcaccacaccgccgccttgaacaataacgtattgatcgtcaccttccagtcccaacgcctccagtgtcgcatggacaccaggcaagggccggccggtacacggcacaaccttgataccggcagcaatcgccgtcttcaaaccgctaattgtagcgggtgacagctgcttatgtgaatttaataatgtgtcatccaaatcaaccgcaatcaaacggtacatggcagtcacaccccttcctcatgccagcttagcacagcggggtgggaggggacaatgtgaaagataaacgttgggaagcggtggataagcgttacttacaatggttagacataaaaacgacttccttaacaaagaaagtcgccagtccgttcgaacgaccgttaataatgcgagtgacaaatccgcagtgatcatcgaatggtattttgtactgtatgccaatcacatattagtatgaaggattgtcgtcttaacagttgttctattactagtgttgtccgaagcggtctccttcagctagcagaacaaaataacgtcaaatgtcaccatgacgccccacatccagcaaccgtaccgtcaaatcttctacccgatagatcagcaaccagctgcctttaatgaacaaagcgcgatcaggtttgcgacttttgatgacatgatcgtcgtatttttccggcagcgggtcgccggttttcaggtagttggtgacttgttcaaagtcgttctgagtaaagcggccagcttggaggagttgcttgaggtgctttttgaagcgtgattgttgtgtgagttggtagtggggcatgatggacctgcctttcttgttttcttaagcgtaccgcaacgaacaacaatggaaaaatatttttatcaaagacagtggtgacttgtgaaggattggttaacgtcatgtcacacttttaaaaagaaattcacaaaattgatttggcttgtttttgaaatcgataccaaaaaagcgttgacaagaaatctgaaagcgctatattattcatgtaatcaaggagatgcggaggagcggcgaaaaatggcaacgatttcagaagtggcaaagttagccggggtttcggtttcaacggtatcacggatcattaaccacaaaccacatgtttcaccgcgcaaagcggccctggttgccgatgccatggcgaagttgggttacacaccgcttcaagctgctcgacaaatgcgtggttctggctcgcagacgattgccgtgacggttccttacattacgaacccgtttttttcagaactcgttgcagcgattgaacgcactgccgatgagcgatcctataagacagtcattgtgcaaacattcggtcagaaaagtcacgaactgaatgccttggaatttctcaagacgaaccaggttgatgctgtgattatgtgcgcaattgagaatgactgggatttgattaagcagtatcggcaatacggtttgattggtatttgtaatgaatacgttgccgatcctgaggttttgatggtgcgtgccgatcaggaaggcggtatgtatgcgggtactaaatatctcttgaatcgtggttatcgcaagctagcattttgcaccgggcagcaagctattcgatacaatgacaaacttgaagatttgaatagtgatcgttatcgtggctatcttcgggcattgcgtgaattcgacttggagccagcggtggaatggcagtttacagatgttggaaccattgctgatggtcaagatgttcttcagcgcatcatggtcatgaagcatcgtcctgatgctgtgatcgccggctcggatcaagcagccgctggcatgattgctgaagcgcagaccatgcaattgaaggtgcctgaagaacttgctgttcttggctttgatgatcaaccgctgagtcaggtggttgcgcggccgttaacaaccattcatcaaccagtacatgagatcggtgatcgtattgctaatatggtcgctgatgacttggaagaaaaaacggttgaagccagacaagtcgttttaccgctttctgttgttgttcgtcagtcggtttaatcttttttgagcaaaattggtatcaataccaaaaatatggaggaaattaatatgacagtcgtattagcacgattagatcaacgtttagttcatggcatcgttgtcaatcaatgggctgctgaggtgcagccgaagcgctatatggtcattgatgatgctgttagtcaggatgaagacgtgaaagctagcatgcggttgagcaaaccagccggcacaggaatgtccatcatcgacactgaaaaagctttgacgaattttaaagctggtaagtatgacgcccaacgggtattcgttatcgcaaaggagcccagcaccatgttgaaattgttggacgctggcatcgaaattccgcgtgtcgatatcggtatcatttttgcagaagacggacggacacagatcagcaaatttgtttccgttaatcaacaagaagttgctgattttaaagaactcgaaaagcgcggcgtccctgtgaacattcgctatgtacccgctgattcacccgaaccatttgataaggccattgcaggcaaagacattaaataatcagcgagttcttggctgaagaacgcgcgaggaggaaacatcatgccacatattttgcaagatatcctgatcattttcttggcatcatacgcaacgcttgataatcaaggtatcacgattatgaactactggccggtgacggtcggactttttgccggattgattatgggtgatttaccgacagccatgaccattgccgggactttccaattaatgagtttaggggttgccggcctaggtggcgcatctgtgcctgactacggcttagctaccatcgttgggatctatttgtcagcccggacaggcgcaggattgggagccgcggttgccgttggactgccagtcgggctgttgacgattcaactggatgttttaattaaaatcgtcaacaacttcattgctcacaaggcacaagcatatgcgcatgccaaagaatttaataaaatgcggatgattaactggcttggaccgttgttcttcgccctcaagaactttattcccatgatcttgattgtcacagttggaccttctgccatcagtgccttgctcaagatcattcctaagtggcttacaaatggtttgacaatcgcaggtagcatgttgccagttgttggtattgggatgctgatgcattacatgcctttgaagaagtatatctgggttcttatgatcggtttcgttatgtcagcttatctgaaagtgccgattcttggcgttgcgatcattggtttggcactagcaatttacacctatcagaacctgatcagtgcttctaagaagaaggaagcggcgacagctaatggtgctgatgcttcagatgatgatgacgaaggagacgattacgatgagtgatgtacagcaaacaaccaaccagccgagtgcgacacaacctaagctgactaaaaaagaacgacacagtgccatccttcgttacatggccatgggcgtcaacaattttaactacgaaacgcagcaggggccatccgttgtttgggcattttcaaaggttctgcggaaaatttatcccgatgatgatgagtatgtcgctgctttggacaatcattttaaatacttcaatacgaccactgcaatggctggcatgatcttaggggcaacgctggccatggaagaacgtgatggcattaagtccaaagatgcggttcaggcgttgaagacatcgctgatgggcccatttgccggcgttggtgacacgatcatctggattctgttaccgacgatcatgggttctattgccggttatatggccctccaaggcaatccactaggtgcaattatctggattctcgttgatattttgctgttctgggttcgaattaagctgtttgacatcggttatgattctggggttaagctggttacgaccatggctaaccaattgagtgctttcacagaagctgcttccgtgatggggattaccgttgtcggtacattgattgcaacggttgttaaagtttacacaccactacaattccagtttggcaaagttaagttagcgatgcagacaggtattcttgacaaaatcatgcctgccttgctgcctgccttggttgcctggatggtttacaagttgctcggttcgaaaaaatggacgcctaatcgtgtcattgtcctaattttagccattgcactcgtaggttccttctttggtattctcgggattgaaccaacaaagtaatcatgatgaaagattgaggggttgatattttgaatcagaagaatcaagtcagcggggatcattaccggtttaccgtcattacaaataagatgatccgcatggaatatcaatctgccggtcagtttgaagatgcaacgacgcaaacagtggttaatcgcgattttggcaagccggattttcaggtgactcgtgatcaagaaggttttgctgtccaaatcgagacagattcatttcacctctattatcgcggtggtgaattcaacggtgccaacttgttcattgatacaaaatacaattttcagacgcactatccgcgttggcattacggtgatcccgatgtcaagaacttgcttggaacggcccgaacgttagatggcgcagatggtgctgtatcgctggattcagggattatgtccaaagacggttttactattttggatgactcaaccagtatgctgcaagctggcacatcgatcaggaatcggcctgttgaggaaattgatctttatggctttgcatacggtcacgactatcgcaaggctttgtatgattattatcagctcactggatttccgccgatggtaccacggtttgcgttaggtaattggtggagtcgcttctatccttatacgcaagaaagttaccttgcgctcatggatcgtttccaaaaagctggtattccaatagcggtcgctgtcttggatatgaactggcatgtcacagatattccgacgaagtatggcagcggttggactggatatacttggaataaaaagctgttcccggaaccagaaaaattattggcaaccttacacgcacaaggcaaacatatcacgctcaatgtgcacccggctgctggtatccgcccttctgaagtgcagtatccagaagttgctgaggctgtcggtattgatccagcctctaagcagccggtgttgtttgatttaaacaatcgaaaatttattcaagcttactttaacttagttcatcatccgcttgaaaaacaggggattgatttctggtggcttgattggcaacagggtgctgcacgatcacgtgcgcagattgatccattatggtcgcttaacgtgctgcattttctggatcaggtgaaagaaaagaaggatcaagcgctgatcttgtcacgctatgctggacctggcagtcaccggtatccaattgggttttctggtgattccattgccagttggcgatcattaactttccaaccgtacttcacagcaacggccacgaatattggctacacctggtggagtcatgatatcggcgggcatatgcacggcagctatgatcctgaattgtcactacgctggctgcagttcggtgttttcagtccgattatgcggttgcacagttcggacaatccgtttatgggcaaggaaccatggcaatatgatctggaaacggataagagcatgacacgtttcatgcgattgcgcgctcagcttgtcccttatctggcgacggcggatgtgttgacacatcagcaaggcatgccattgattgaacctgtttattatcgatatccagaagtaaaagaagcttatcagttcaaaaatgagtacttcttcgggtcagaaatgctggtcgtaccgatcacaacgcctagtgatgacacaacgggcttagccagtgcagaaggttatgtgccagccggtacctggaccgatttatttacccaccagcaatatactggtccggcagttgttaagttctatcgcaacaagtttcagtatccggttcttgtgcgctcaggtggcatcgtgccattagctgatgacgctatggcggccattgatgatctgcccgaagctatgaccgttacgcttttccctggcaagcaacatgcctatgtattacatgaacagacagcggctgggaaagcgcaaaccaaattttcttgggatcccgtggccggtacatttgggatgaccgttactgatcctaatcacatcattcccgagaagcggacctatcaattacaaattgtgggcgttaaaaccacaatgaaaccattctcaggacgatttgatcagcgactgacacttgatttagaagccgaagatcaacaggcaattaaactgcagcatatctttgcaattctgcaacatgctaaagttgcgtttgatctgaaaaagcagttgtggcaaagcgttaacgatatgccagcaagtagagcagcattaactgttgccagtctcgcaccggcaacactgagcgatgcacttttggagatacttttgaatgattaggcctgaaatgaccgtcctttggtcattgcggataaggtccttaggtgcaggtttctggtctggtaaacgtggttagaggaggaagattcatgaaacgcacaatcgtattggcgtcacatcatcggctcgctgaagggttgaaagacacattgaatttcattagtggcggcggtcaagacatcgtgacgctggcagcgtatttggacaatcagccggttgaaaagcaagtcgatgaggttatgactgctttcccagctgatcgtgatgttgtggtattgacggatatgacggcagggagcgttaatcaaaagttcttcaaatatcgcacacgtccgcatacacatatcatcagcggcatgaatctgccacttgcacttggcgttgcgatggaaccggctgatcagtatattagcgatgctcgaattgatgcgctgattcaagaggccaaagatgcaatcgtcaatgtcaacgagattcaagttgaggaagatgacgatgatgaatgaaataccatggtggaaaaaaagcgttgtctatcaggtttatccgaaaagcttcaatgatagtaacggtgatggcgttggagacttaaatggtatcactgaaaaattggattatttagccgatttgggcgtagatgtgctctggctgaatccgatttaccgatcaccacaggttgataacggctacgatatttcgaattatcgcgatgttgaaccacaattagggacaatggccgattttgaacacttgttgcaggcagcacatgatcgacatctaaagattatcttggacttggttgtgaatcacacgtctgatcaacatccgtggttcaaagccgccaaatcatcagtgagcgatccgcatcacgattactacatctggaagaagccagttgacgatcatgagcctaataattggggctcaagctttggcggttcagcttgggaatacaaaaaagatctgggcgagtattacctgcatctttttgccaagcaacaaccggatctcaactgggaaaatcctaaggtacgccaagaagtttatgatctcatgcgcttttggctagataagggagttgatggcttccggatggatgtcatatcactgatttctaaagatccggcttatccagatggcccgctcattcaaggcaaggcatacggtagttattatgccggagcggcaaatggcccaaaggttcatgattacctgcaggaaatgcacgagcaagtgttgtcgcactacaatatcatgacggttggcgagacgccccatacaacggcacagcaggcgcaattatacacggcggcagatcgtcacgagttggatatggtttttcattttgaccatatgcatcttgactatggccaatatggcaagttctcgacaaatcgatttaaattagttgatctcaaagaagtcttggcacgttgggagaacacattagcgcaagtcgatggctggaacagcctttactggagcaaccacgatcagccgcggcctgtgacacgatttggagatgaaggccagtatcgaattcgatcagccaaaatgctgggtacggtgttgcacatgttgcaaggaaccccctatatttttgaaggcgaagaactcggtctgaagaatgttcattttgatcaattaagcgattataacgatcttgagaccaagaacattttcaaagaactcacccaacagcatcatgaaagtcctgaggcggccatgaaggccatttatctgcattcgcgcgataatgctcgtacgccgatgccttgggatggcagtgaaaaaggtggtttcaccaccggacaaccatggctgggactaaatccagatcacaagcagattaacgcggctaaggatctggcagatagtgacggtgtttaccactattatcaacacctgattaaattacgacatgaagagccattgattaccactggtgtatttgaactacttgcccctgatgatccgaacttgtttatttacctgcgcaaaggggaacatgagattttgctggtggcaggtaacttctcaagtgaggaacgcacatggtcagtgccagatgacttgcaagctaaggatgtggatgtgttgattcggaatagtgaaatttccgattcactaaagaaaacactgacattaccaccatttggcgcagtggtgtacaagcttcaatagcaatacgagtgagttcgaattcacgaaaaatgctcatcttctagtttggcttagaagatgagcatttttgtgttatatcgtgtctttgccagaaaaattccatcaatagattttgttactggagtgtttttgacttaagctgttttattgaagcagcattaagttctagaacgcaagcttgtttatcgtttcatcttatccatatccgccaacgggctattgtacaacttagcatagaacccaccagccgctagcagttgctcatgggtaccagattcgatgagtttgccttggtcaataacgaggattttgcttgcattgcgaatcgtggataggcggtgcgcgatcacgaagctggtgcgctgttgcatgaggcggttcatggcatgctggacatcagtttcggtgttggagtcgatggaggcggtcgcttcatcaagaacgagaacgggtgcttgggctgcgaaggcgcgggcaatgctgaggagctgccgctggccttgcgagaggcggctagcgttttcgctaagcatagtgtcgtaaccgtctggcagttggttaatgaagccgtcagcatttgcggctttggcggcagtttcgacttcggcgtcagtggcgtctggccgacccatgcgaatattttcgcgaatggttgcggtaaaaaggaacgattcttgctgaacaactgtgacgagccgccgcaaactagcaaaggtaatttgggtgacatcgtgatcatcaagggtaatgctgccgctggtgagtgggtatagatcggtgagcaggttcataatggttgttttccctgcaccagtcggaccgacaatggcgacgacttccccttgatgagcagtgaaactaatatcgtgtagcacctcggttttaccgtcataggcgaaggagacgtgatcgaacttaacattgcccgctgtgtgatctaactcgacggcattcgcggcatctttttcaggctcagcatcgacgacttggaaaacgcgttcggccgaggctaaggaaagttgcaaggtgttgatgaggttcagaatgttgttgatcggcccagtaaagttgcgcagatagatcaggaaggtgaaaatgacaccgactgtgatactggtcccaccgcgaagaatggcaagcgcaccggcaaatgtgatcagcaagtaggcaaaattattggtcatattgttgaagggaccgatgaccccagagaaaagttgtgcgcgataggctgcggcagtgtagcgggcattggtttcattgaaacggtcaatggtatcctgttgatgatcgaaaagctggaccaactgtttaccagaaacattttcttcaatttgggtgttcaagctgcccaattcttgttgctgaatcgtgaaggctttttgggtgatgcgtgctgcggttcgcgagtaaaagaaagtcgcgacagacgccagaacgacaatgccggttagtagcgggctgagtagtaacatggcaatacccataccgacaacactgataatgccggtataaagctgtacaaaagtttgcatcagtgcggtgttgatgttgtcgacatcgttggtcaatcggctcatgatatcgccgttatcatgcgtatcaaaataccgcatcggtaaacgctgcattttggcaaacaggtcgtgcctaatcgcagcactagtgcgttgtgcgactttggtggtgatacttgtttgaaaatacgtgaagatactgctcaaaaaatacattccagccaacaaaccgctgacaatgaacaattcgcgcagacggcctttggtgataaactggtcgaccacgatcccattgacccggttgccaacaatggtggccaacgttgtgaataatgtgaggccaaaaacgatcagcagcttgcggcgatccgtatcgagatagccccaaatccttcgcacggtttgtttccaatcaactaaggtgactttttcggggtgcaaattacgtggcccgcgtctgccgttgagattaatcaatgtagtcacctcccagttgggtttgaaccagttgcgcgtaaaatggcgaacttttgaccaactcggtatgcgttccgcgagccgtaatttgcccgttttgcatgacgatgatttgatcacagtccatgatgttcgggacgcgttgcgaaatgatgatggttgtacggttgcggcgagccttaaccaaggcatcttgaatctcagtgttggtttcctgatccacagcactggtagcgtcatccatgaccagaatatcaggatcggggatgatggcgcgggcaagattcagacgttgccgttgaccgccagaaaagtttttcccagcttcttcgacgggggcatcataattagtcccgacaaactcagttgccctagcgatagcaacgccgctggctaattgtgtcggcgtggcttgcggcgcgccataactcagattatgcgcgacagtgccagaaaaaagcagtgagtcctgtaaggcgaccgtgatttttttgtgtaaagccggtaaggtgatttgttggatatcggtgccaccgaccgtgatattgccttgataatgctcataaagtcgggttaataaggcgatcagcgtggttttgccagaaccagtggagccgataatgcccagccactgaccgcttggaacggtgagattgatgtcatcaaggatcggtcgactttgcgaaaaaccaaagttcacgtgctcaaactggatggtgctaccagctggggcaggtaatgtcccactggcctcagtacctgcttcttcggccaaaacggcgttgacgcgtgcactagaagtaattgcccgtgaaaaggtcgtgatgaggttaacggtattggtcatcgccgtcgtaatttgaatcatgtaattgacgaacgccatgatttcgccagtggtgatggtgcggctgatggctagattgccgccataagccagtgcagcaacgactgccagattaagtaccagcatgatcagtggcgccaaagtgaccgttgccaaaacggcgcgttgactaatcgtctgcaggttgcgattttcagtgttgaattgagtcagttggtggtcttccagtacgtacgccttgatcgttttggcgccagtcaagttttcactcataatccggttcatgacgtcaacttgtccttgcatagccgtgtaaagtggcagcgaacgtcgaacgatgacgtagatatagatggcaagaatgggtaaggcaatcaaaatgatcaatgacagccgtggtgatacgataatcgacatgacaatgccgccgaacagcagcataggcgagcgaacgagtccgcgcgtcagcatgcttaccagcgtctgcatttgcgtaacatcgtttgtgatgcgggtgatgagtgtttcgggtttgagtgcttggggatcgcgatcggccagtgaaatagccagcagatgagtccgcaggttttggcccattttcaaggctgcataggaggagaaggcgttacagatagcacctaaagcgaacgcagcaatagcaatcactgccatgagaatagcggtatgccaaacataagtcatatctttcttagccaatcccacgtccacgatgctagccatcaaggtcggttgttgcaggtcaagcaatgcttcgcccatgatcgctaacggcgcgagaaaaaaacttacccgtgcccagccgtgcatatggtcgaacaaaattttcagcatgtcagttgcctccgttttggttattgagctcattctacggctggattgaaaaagatgcatgtgatcagcttgttgaatgggtagacaaacgatgcttcggtgctttttgaagatgaagaagtttccagagaagttggaggttgaagtaggtagatagacataaataagccgccacggaaagcttgtacagctccgtgacggcttatctttaaactgggttgctgcttgctcggctcgtgacgacttagttcaataaacgagctgccgttaagtagcattgttgaaccatagcgcttgctcccaccagcaacgcttttggtacgctcaaatgctatcatgtcttgctgatatgaatcaacggattagtatgtttcatatgagtgtctctttttaatatataacaaatggtatatatggcgtgagctaatagcgactgatagactggaaacgacaatgctacgcgacggtggctctttcttaagaaggaggtggtggctatggttttagaactgtagagatcacaaaattctttgaaaggaggagcacgatgtcgatctatgaagctttgagccttatgatcatgttcgggttgtttattctcggactgattaccttggttctgaagctgaatgatcggtgataccaaaaagccgtcacgagctagctgggtaggcttatcgtgacggcttaattttactataggccaccggttaagcagcattgttgaatcatggagtcgctggttcccgccagcggctctttttcgttacatatatattaaaccatgacaaggcctttgtaacaatctgtcaacaccatgttttgcaaaaagattttcttacacttgattgataaaggcgtggtggcttgaaaacagtccctaatcatggataaaagattatcaacagttgcccaaatacaaggtgtaagcagattgttacagctcaactgacgcagctttctacgttattcaataatcttagacttccgcgtgatatggtgcattttctcgatccacgggcgaattggttcttttaggaaaaaccccagaaggaagaaggcaacgccgaatgccacgaggatgaagagatcttgccacagatttggccagtagatcccgccaacggtttcgcgcagcaagttgacggcataggtgaatggcagccatgggttaatggcttggaagaacttacctgagagtacaacggggaagttgccacctgcgccggagatggataggactaaaataatgattcccaggcccttaccgatattgccgaacagggaaattaacatgtatagaattgagacaaagactaggcttagcaacatcgcaaacagcaaatacagcggcttgtcgacaacgtacgtcccgattaggaagaggttaccgagtgcggcgatgaggccttgcagcattcccagtcctgcaaacgttaaccagcgagcggtgtacatctgtttgacggtcgcatgagccaacgattccggcagctgatattcggtaatgagaatggcgccgagcagcaaggcaccgacccaaatacataaggccaaataaaatggggcactttgcgagccataggttgggatatgatagaaactcgtttgcttgagctctaccggtttagctaaaaagccggcttctttcgtggcatcacgtctcagcagtttgatcaactgcgacagatcaacggatttctcgccttttttgattgcggttgcgcctttttgaatggcatctttcaatgttggccagtcatctttgattaaggtttgtgcatcatccagcccgctttgtagttgcggcattttttcgttggctaaagcgagcgttgatgtcaggtcgctttccacaccgggtagatcttgattgataaaatttgttgccttggtcaatttcgttttaagacttgggaagtcattttgatataagtcagcgactgtcgtgataccactggtgatcaagttcatatgaccgttcagcagcgtattggcatcagtgagttcctgcttcaaggctggtaactgtttttgggttttaaccaaaaaagtgttggcttgtgtcagtaagtcctttgttccgctgagtaaactcggtagttccggcaatacttgatcgttgattttagtcagcgttgtggcagcatcagcaagcgcagccttgaaagcgttcagtacttgcttcacactcgtgccgagatccagatccttgagtgtattggcatcacttgcaaatttctgagcgacatcattgagtgtcgccaaacgactttgtaactcattggtacttaaatttggcacgtctttggcgagatcgctggcggccgtctgaacagcagtagcggtagtcgcaacatcacgcagtcgcgtaatggcaccggccaacggttgatcgtccttaccggtcagcttgttaagactggtttgcaggcgggttaatgtatcggccagactggtggcattggctgccactttgccttggcgatcagataaagcggttaatcgggccaccattgcctgtttgatagcggcggtatcactgctagtgtccaactgctgcaactgattttgcaaggtagttaagtcagcacttaaactagtattcgcggcggctatcaatgtcagaccagcatcgaccgcattttgaaccacatcaagtgctatgctgactttgggcaagacttcatctttggtcgtgccaatcgctgcctgggcgtttttgccaaagtcggtcagagcaggcaaagtgccgtcaacttgattgacgacggtaatgccctgactggtgaccgccacggccttcgtaaccgctgattctagttggccaaagttggtggtcactgtattaagctgcgcaccggcttgttgcacttcaggcaacttgctgcgaacatcgaccgccaactgaccggcatcggctaccattggtaaatacccgttggctgccgttaatttttgggccatttgattgacttcaggcaagtaggtggccatttcgttggcggccgccagtttttctcggatggccggcattttactctgcaaaaccccgacttccgcgatgtatttttcaattgtcggtaattgatcgtttgtattggttaccagacttgcaaagcgccgaatcatcggcagattgtcatccagcttaatgcctgcctgattgaagacagtcaccaaggttttggcaacggttgacacaaattcgtctgaaatggtgttttgcagcgtggacgccccgcttgcagtaattttaggggcgatggcattaattttttcattcacgtaataatctagctttggtttgtgaatcttaccatcgacaaaactaagcaagtccgttgagaaatctttgggaacaacgacacctgcgtaatatttgccgcttttgacaccttcctgaaccgcctttttggagtccacaaaacgccagccgagttgcttgttatgctttagttgggtgaccagctcatcgccaatggcaatttttttgtcacggaattcggttgatttatccgctgaatacacggcaacagtaagatcttgggtattgctgtaaggatcccatagcgcccagacattgaaccaacagtagagactggggatcacaaccagcgccaaaatgagtaagaaagcgaatgggcttttaacaattcgcttccagtccagtgcaactaattttcctatgtttcgcattgtgctcctccagtgattttcaaatttgtatttgtagattataacatgcgaatattgaaaagttttttaatgcctaagttgttccccaatcatcttttcaaacctttgtcttgacattcacaagcgcgggccgtatagtccttccaacaagactttaggtgttactcagcacaactttcaaagtgagctgaatgacatttataaaaacaacactttgagaagaagagtaaccttggcgcagacgctgtagaaagcccggttgatggaaaagggtcatctgcaagaaggtgaagatgagcttcgaatagttattcgtgcggttaacgctcacgagtcggttacggccgttatgctgtcaggtatcaacaggtactggagacgatgtatcaacatcgtgaataagggtggtaacgcgacactgtcgccccttgactacaacaaaagtagttaaggggcgtttttttgtggcagcgcaaggttatctaaaataaatcaaagttgtttaacgagatggttttgatagtttgctggtggaaatgtttggaggaggatctcttatgagtcgttggaaaaaagctatcttcacagggattgcattggtttcattattaacactaatagcgtgtggcaaagcaactagtagcaatagcagtcatactagttcaaaaagtgagtcaatcatcatcggcagtagtggctcggattatcaaatttggcaacatattgctaaatcaccgcaggccaagaaggctggtctgaggattaaagtcaagcaagtttcagatggcaacgtcactaactcagctactgccgagggacaattggatgttaatgcattccagtcatatgcttactttcagcaatataacaaattaaatccgagcgaaaaattagcagcattaggcacaacctacctggaaccaatgggactgtattctaaaaaatataaacagctgcgagagattccagatggtgcaacgattggcatctcaaacgaccctgctaatgcgacacgcgggttacttttgctagcaacggccaagcttgtcacccttaagtctgacttcaatgctttaagtaccgtgaaggacattcaagccaatccgaagcacttaaagtttaaagaggtcgacccatcggtgcaaatgctgcccgatttggacgcagaactgatttcgaatacgcgggcacttgatggtgggctgaatgttttgaaagattcattggtgcatgagaagttgaaccaaacgacgcgcgccaacgtcaatatattagtgaccgcagtgaaaaatgaaaaaaaggaagaatttaaaaagttagtgccgctttaccatgaccctacgattcagagttggattaaaaagactttttctggcacgaaacttgatgtgaataagccgatcagttatctccaacaaaaataataataacgagatcgctgtgaaaccagtacttatggggctgtagagcagctttttgttgaaggggatcgagccattaagcaattcgggttataatgacagtaatcggaaaaattgagctttaaacactgacatttattttcgaaaggggtcgttgctatgtgttcttcaatgacaattaaatcgctacaaggtgatattttctggggccgaaccatggattacaacaccagtttctttcatgaatcaccagtcggcggggttcctggtaaaattgtcagtttgccagcaaacaagacattaccaacacaaagtgtcaaatggaccacaaagtatgcagcggttggcgtcggtattgatcaaagtacggcacttttcgacggcgtcaatagcgaaggcttggctggcgacttgcaggttttggtagagtgcagctgggcgagtgcggattctttgaaacagcgtgggctgaaagctattaaaggcgaggagtttgtgaccttggccttgacgacatgcaaaaatgttgacgaagtacgcgctttggcgggtgagtatggcctgctggatgaaccttatgagtttggcggccaaggggtgaaaatcccattacattacacatttgttgatccatcaggtaaagggattgttgtcgaaccaaccgatcacggcgcctttaagctgtatgatagtatcggcgccatgacgaatagtcctgaatacgggtggcatgaaaccaatttgcgcaattatgtcagtctgaatgacaataactatcctaagggatccgagttaggcgactaccatattgagccgattgagttaggcacaggctacgggatgttcggtttgccaggcgattacacatcaccatcgcggttcctgcgggcaatgtttgtttcgcgtaatcttgatcccttcaacagcaaagatggcattcgcgtgttatacaatgctttcaagactgtcttgattccgcaggggctaggtcgcgacccacaacatcaggttttaacggattacacgcaatactggtctggctatgatctgacgaaaaagacgattttcgtgcaagattcagacacattgacaatgacaacgaaaacacttgatccgactattactgacgtcacttatgaagatttggctaaaactgaacagttcaatcaactgtagactgacatcattgatatgaaaaaaggcaacactgaacgagagaccaatcattggttttggggttcagtgttgtctttttgatttgtcatctaacgagccggagtggtgacttggtatcgttatttgtcgtgtttgtgcttttgccacccagcgatcggaacaactcgattattcgttgtcgtttctgttgggttactagtaggttgttggggtgctggtttggcggcaacaagttcttgaacgcgactttcggcagctgtagcaagtgcctgtcgctgggttggtgtccagaggtgggaggttgttgtagatcgaatgaaaatagcgaccatttgtccaatgactgcgcgctgatcaggaccaatggtttttttgtcatatagtagcatggacatggcagccttaatgtcctgagcggtccaattctttggatcgtggccgaacaaactctgaatcgtgtgggcaaggaacaacgtggtggcaccaaagagttcctgattctgaactggcttaggaacctgcagccacgttttggattctaaaaagttcatcgtcaattgaaataattcagccatattttcggaatcaaagtcaacgtcattatcggggtcactgaaggcatcatcaacaccaggaagatcaaaatcatcattgccgaatggtgatgtgagggcctcctcttccgtcaaaccgagcagataggtggcagtgacgaacacgttcatcaaggcatcaacaaattcaaggatagtcaatttaatctcatttgttgcaatcaaccagagcataaatgtttttaacagttccgccgcgatcgctaacgactcgctgcgatccaatgcatcatcatgataagtctgtaaggtctcctgcaaaccagctgcaacgtgttcagtatcaagcgcttgaatggttgaacgaaggttatcaaaggcatgcacgaaaaaggtgacgaggattaatcgaatttcatctggtggcacttggctaaagccgggaactgtcagcaggtgttgataacttgtgcttttctggaaattttcccagtatttatcgatttcgcgactggcatggcgtcgcagttttaattcgtagtccatgatctgcctccattaaaattggttggattcactaagaacagtttaacagtaacaagcttgaactgatagctgttagcattatttttagtgcacaaaaaggaaaagcgttgcccgtgcacggacaacgcttttgatattgaacgttattattcaaacatttttttcgtggcacgcatcaatgtcttgatgtctttatcataccgcggtgttttaactaaatgactcattggaatgccggtgaaatgataagcggcaatctcacctgaacgaacagcactttgctcagtgaagaccatttggaatggttgttcagcgaattcaccggtaaaggcaaggtttgttgaatgtgctggaatcacatctggccgatcaaccttggcgcgattgttgaagagtgccgaagcatatggcatataaacagggatgttgttgatgatgcttgccataatctcatcttgatgatcacgaatattaccaggaccgggatcaactttagcaagctgaccaatcaattcaaaggccatctctttacccgtcatttcgatatacggcttgttgacaaattcaccgtagcgccgtggataaaggaagtagccccacaagacggtctcgtttggtttctgggtggtaaagtgcggctgatgatgtaccacgattgacatcatgacatctttttgcccaagtgccgtgattggttgggttgacatgaacgaattcagggcgttaccagggacttgcgttgtaatacgttcgatttcgttaagcaacaaatgatctttggtcgtcaaggtgaagctgacccactcgctggctgaccgatccgcaaagaacttatcaggattaccaaggttataaaaatgctcagtcgcttgtttccacagacttgcggcagcaccgtagtccatgttttcgactgctgcatgatcaaagtcaccttgagttgcggagtcggtgatcgatccattcgtgaagaaaacggcggtatcatcatcaacggtaacatgttcttcgtcatcagtctctgtgttcagaatggtcaggccggtgacggtgatttcatcagtcatggccgtgtctttaaattcaaacgcggtgacacgccggttcaaaatgatcttgcagccttgctccttcaggtaattaatcagtggcagcataatgctttcaaattgattatagcgggtccggttaaccccgactaaatgctcaatttgagtaaattcataaatcatcatgtgcatgtaccgccgcaattcctgcgcagaactttgtgtgcggaaggcaaaggtggtttcccacatataccagaaattggtttggaacatgtgcggatcattcttgaagtagtcggcgatgctaacattgtcgagcttttcttcttcggaatcaggcatcatgattaacttcgtcagcaaaaggcgatccgtgttattcaggcccaagtgtcctgcttggatgatgccaataccgccttccatcaaccgagctttatcaaacgtccgatgttgggcatcgaattggcgcgtgtcttcttcagctgtgagtcccggttccgttgccgatggaatccgactaagcaaatccatcaaatcgacatacgtccggtaattcaacatccgaccgccccgagcaacatagcccttcgtgttttccatgggatgatttttgttccaatattcatccacagtatcgactgttggggcaccatcatttgaaccatggtcatccagtgaatagaaggtgatttgatcaccttgccaatgagcttcctgaatgagataaacagctgcagccatattggccagccctgcaccgatcatgatcgccttatgcttgatcattttcccgcctcctagcgactttcgaacttattgtatgcgtcagcgtcatctttaaacagctccattttgtttgcaaagtagcatgcggtgccgccagcaaccagcgcaacgcctagcgctgtcaataagaatttcttcatctaaaaacgcttcctttctgatgtcacctatattataggcacaagtaaaagaagcgtctttagtcaaattgtgatgtttgttcgaaaattaacttttattgtgggccaagtgaccgcttgcggacaatgaaagcaatcgacccgtttaacatcaaatcagcccgcttgatcagattgcgttccggttctttcaaggactgcgctaaccacagcagcacttgccctacgatggctgcaccataaaagttgcagatatcggcaacggtttgggctggtgttgctgggtcaatgtccaaaacgactggtttcaccatgtcggtggctgactgaaataagaattcttccagcatgtcacggccaactgaatgaaacgcattcagacaaaagatctgattagccacgatatagtcaagcaccagctgatactttgtttcccatgtggccgcgcctaagtcctgcatcactttacggccaatgtcagcctctaaggtccatttcagtaaggcatagatgtcatcaaaatggtaataaaacgtgttgcggttgacatgtgcagctgcgcttaactcggcaatcgtgatgcgatctaatggtttgtgctgcatttgtactttgagaaccttggcaagatgcgccttagtttgatcagatgtggacatatgcaatctctcctgtagccatggtcaacatttttggcatgaaaaaccgcttgtcagttgttcaagccgacaagcggcgatgacttactttactttgagtggtttcaattgcgcttcgattttgtcgagggtgacattggcttctagcaatgctgcggctgcataagccccttcaacaaacgcgacatcataaacatgcatctgtttatcactgacttcttcggcaatgtccaaattcattttcgcactgccgaggtcgtagaaaacaagcagttcagaagctggattatcgccaattgctttttgaatatggtcgagatccgtgccgattttgccgtcgctagtaccgccagctgtggtgataggaacatctttagcgacttgtttgattaaagtttcaacaccattggcgatcgccggaacgtgtgaaacaagtaaaatgcctagtgccataggatcactcctttacaagtgtttgccttcatagtttgtcggttgtcgatcaagcggtcgcatctaaataggctttcaacaattcgccagttgaagcggcgccgggatcaatgtggccgacactcttttcaccaagataagacgcccggccgcgtttagcgatcattggctcggtggaagcaaccaacttgtcaatggcggcgtcatcgagcttgccttgtttgatcaaatcagctgctggtgcccagacatcaagcattgtcttatcaccggtttttgcttggccgcgcttagcaataccctttgcggcagcatcgacgaggtcgccaaaatcggtgtcggttttggcaagcttagccatttcgagaaaggctgtaccatataaaggaccgctggcaccgccgactttgctcagcatggccattgcaattgtcttgaagtcttgagccagatcggtagtcggtggggttttttcgaaggctgctttgatcgcttcgacgccgcgctccatgttgttgccgtggtcagaatcgccaatcacgcgatcaagttcggtgagatggtctttttccttggtaatgcgagtttcaaaattcgtcatccatttggttaatgtatcagcgtttaacatcggtatcccccaaccaacagtgtgggctgacgcattcaagtaggtcagccattgcggatcgtctaaagccaacatggtcaatgagatgccagccatgtcgagtgatgtgacatagttgccagctttggtgaagctgacaggtaacttttcagtcttcagttcattcagcacatcgcccatgaaaatgtattgttcagacaacggggtagcacccatgccgttaaccaagacggcatacttgtgggcttgtggatctttgaactccgccgtcaacttgctaatcagttgcttagccaattgtttagaggtcggcagtttttcctgaccggtgccaggttcgttatgaatgccaacaccgaattcaatttcatcaggttttaaatcaaacccgggtttgccgacttcaggaaccgttgcagcgtgcaatgctacggcaaaggacttggtgttcttaacgacggcatcgcctaacttcttcaggtcatctagacttaaaccagcttcagcagccgcgccgataattttttcggcaaaaatagtaccagcgacaccgcgccgaccttgcgtgtacagtgaatctttgacggcaacatcgtcatcaacgactacggattcgacggtgatatcgtcaacactggcaaggtctttggccatgtcgaagttcatcacatcgcctgaatagttcttgacgatcatcaaaacgcctgcaccttggtcaacttctttaatagcagcgtaaatttgatctggggtcggggatgtgaagacttggcccgccaccgcagcatcaagcatgccttgaccgacatagccggcatgcagcggttcatgaccggaaccgccgccagagatgacgccgaccttcttatgttgtttgaacgcggcatcatttctgacgaccgccgttgtatcaggaatctgtttcaaatattgcggatagctggcagcgagtccagcaatcatttccgggacaatatcgcccggtgcattgatgattttcttcatatttgcaactcccttctagttatcagtgtaaccctaacaatgctaaaatacagtgattttctagcagatattgatgttcagattgccttaaaaacggtgatggtgcatgtcatgctgaggtgggtgggtatccagcaaaatcaaatagatggcaatgctttgctgcagaaggacgcataagaaaacccgttttgctgatagcagtcggcaagcgggtgggaaaaacttttaagggtgcatggttgatcaacttatgttaatcataaagtaagtctaaagtctttgcaatcgcttacacaaaaagacacaacaaatctgactttgttgcgtacgcgcctggcagaagacacatctaaaggaatcaggcttcgatcattggcctcgggcagtttagtctttaaaatcagtcactgtttcgatcgtataattgccactatttttgagcaacttcgaaacgggacagcgattttcgatttcgttggtgaaagccttagcagtatcgaaatcaacgcctttgaccatgacctgggcgtgcaccaaaaattgatattcagcgcgggcgccgatgaaagcgaccttcacccgcacggctcctgtatgcggcaaaccgtgctccttttcaaccgcttccagcgtggcttctagacatgtgcttaatgatagccccaaaagttgctctgggttggttccgggatgatcattcatcggactgctggtttgcactttaagtccaccgggaatataagcgtggccctccagcccttcgtcattaatagccgtcgctgtatacagcgggtggttccagcgttcatcttgcatggtgacgcctcctcatataggtcattgcggtaattcaagttttggtgcgtggatgcgaaacgtcattacttggatcaggtttctgataaggttccgggtcattggcgtgctcaggtggccgttgttcaaagccaatgtctttagtgatgagtgggctgccttcccagatgagatgttccagcaacgccattgtggtttgcgcatcgctcaaggcggtgtgggaaggcaaatcaaccccaagcgcctctttgtaatgttgcaacgacggggtgtgctttttgccgatgccgaatgttttacgtgccaaagcagccacatcgaaggcttgcactgggatgatatcgacattcagtcccgctcgtagcgcacgcaggtcgttacttaaggcaaaacccacaacgagttcatgcttcaacaattgttcaacggcagctttggcaagtggcagcggctgaccatattgggacaacagatcatcggtgatgcctgtgattttgactgaaaatggcatgacgtggtggccctcaggtaattgggtaaaaatatcgaaggccccatcaacttggtgatggcgtacccggagtaaactgatttctgtcagatcaagttggttgcgatcggcgacgaactcagtatcgatgacaatgtaatcaccacgagccagccgatcaacaacatccttttgcgaccgcagtggggcttgatctgaagctaacatggccatggtggctgcatcaagttgaattgacttagcagcgcgatcattagctgcttggaccaacggcgcttcttcaatggcaaacttggccgcaagtcgcgttgtcaaacggtcggcctgctcttgccgttgacgacgcagatcagctaaagactggtctggattgcctaacgaaatgccaaagagtctggccagccaagtcgcaggagcagttggcatgctggtcaaaacataggcgccgttaagatcggctaaagagaaaacgacctgaccattttcaagccaattttgtaagccaattgcaaggaggtgcacccagtcgctaaaaggttgcatgatcaacggcaatttgttggcggctttcatttgatctaactggtgagccgccccagcgacagctagagcgaggccgcgcgtcagacttttgcgatgattaccaaagtcttgaacagtgaatgcgattgggagtaaggcgccacgcggtcgtaaggtatagcgtaggcgaccgccttcaggataccagcgcgcgaggtcaaactgaacctgcccatgtgtattgacttgattggttgaacttggctgctctggacggtactcgcgatgttggagaatcgccatcatctcatctaagcgaatgcgaactgcggcggcattgtggggttttacgatggggtcacgcaacaatttattcaattgtcggcgagcctgccgcggtgagcgtgtatttctttgccgatcagttgtacgagccatggtgacacctcctttgagtgaaattttgaacacaggaatagtataccaagtggacacgagatttcacatttttgccatgattattcgagactagcaggtaaaaggggcctttacccatgaatgtgggttaaaaacttatttacccaaaacatgaaccgtctatggagaattgaaaagcttattttttcaaagaaagtttgcttacagattaagtttgtggcataactgttgtatggatatcaaacaatcaacagacgaaattgccttcaaacaacgaattttctttgctttgtctgaacctggtcgctatacgattgtccgcatgctttaccacgtcggtcatgagatgggctgcaacgagctgaaccagcacgtggagattgacaaatcaacgatgtcatatcatttgcgaacgcttcgggaaattggcatgattaccacgcgtacccaaggacgacaaaaatttgttacgctgaatacagggaaaattgaatcggttttcccgggtttacttgagaagctataaataagcacatggttgcttattttttagcactgattgtttgataattttaaaaccgtaaaactgattggagactttctgatgaaagaacgtagactttcgtttctattcttcttagtgatgtttgtgattggcaccgatacctttttggtttcaccgttgttaccgacattgacgcaatactatggcatttcgactagtctatctggttttattgtcagcgcttatgcagtgggctacatgatatcggcattattgattggtccgatttctgaccggcacgaccgcaaacgtattttgatcatcgggttaatggttttcacgttggcgactgccgggtgcgggctggcgaatacgtttgcgatgatgcttgtcgccagattcgtcgctggtgtcgcggcggccacggccggaccgcaaatctgggcggctatcccggtattgtttccaaagacgcaagttgtcaaagtaatgggatatgccacggccggtctggcggttgctcaaatcgttggggtaccattggggagttacttagcggtatggtcatggcgatttccgttcttcttcgttggcgtcattgccttgatgttgacgatgctggtcgtgcgtttcatgcccagtcttaacgaggcgacaacttcacgtcttgcaactggtatctatcgcaaactttttcagaacaaaaccgtgcttaaactgctaggggcatacttattgtttcaaactgcaaatttttgcggtttcgcctttatcggcacttggtttgcgaaaagcttccatttatcagttggtgccattggcagcttcattcttttaatcggcgttggtcagtttgttggcagtttgctgggcaaccgattagtcacttggttgggtcagccgcatgcgtttctgcttgagttcttacttttcattgctgggtatctggttttgcctttcaccaattcgccactgacggcaacggtcattctggcgtttatctatacaatcggtggcgcactgctgccattgtttatgagtaccttgcaagaacacgcgggatcagcccgcagcacgatttccgcgttggccaatgccgtcatgtacttaggtggtgtcatcggcggtatcttgattaaacagtttactggcttctcggggattgccgtttttacagcgattggcgcaagcttggcgatgttgttatatgcccagcagggatattttaagcaattgcagacgagtcgttaaacacatacagtacggctcaatgaagctagtactggaagactaaatttttttgctaattcagttatgtggccgccccacagcatccaagccatttacaacgaagacactattgttcttgaagaatgagaaaggtatactcgagataagaacgtatgtttgctatttgggaagaaggtaccagcatgcaagaaaatttatctcagaagatcttagacttgttagatagtggccggtttttgacacttaaggaaatagctaagttattgaagatgccagagaagccggttgaggaaactttattacacttagtaggattacagaaaatgaaccgacgtcactttgcagggcgcgattattttcagaccactcagccgcaacaggcgaccagcaaattaagtgcagttgcagatgattacttagatcaacgacaggcagcccatgcgcttggagtagcgcgaacttgctaccaccatttggctgggaaagctggtgttgccttatttgaccagctgttagccaaaaagatggttgtgctgacggcaccaaatgtgtatcagcttactgaaaaaggccgccacgcatttgcgcaattcctcgggcgtccagtgcatcagctgaacattcagacttgcattgatttttcggaacgccgggttcatttggctggcaagctaggcaatgatgtcatggctaaacttgtcgctgagcatcaacttgctttgacgcagaatcgacgcgtgcaagtgacccagccgattaagatacaaccgctggaggtacgatatgctggctgaaaaacaccgttgcgcatggggacaaaccagtaatgacttgatgcgcgagtatcatgatgaagagtgggggcggcccagccatgacagtcgccacttatttgagcttttgtcgcttgaaatcatgcaagcaggtttgagctggcagaccgttttgaataaacgcgctgctttcaaacaggcttttgctaactttgactatcggcaggtgcagcagatggcaccgaagattcctgtgctcttagaaaatacgcaaattattcggaatcggctgaaagtgacggcgatcattaacaatgcgcgcgtgatcgcacagttagctgccaaaggcgaggactttgatcattacgtgtgggcctttgtcaacaatcagccgattcggcatcatattaccagtcatgatcaggtgcctaacacaaccgacttggccaagcacatgagcaagcaaatgaaggcagatggctttgcatttactggtcccgtcgttatctactcatttatgcaggctgcagggttggtcaatgatcatgaagccgactgttttgttaatcaaatacttgatgagtaacgaaatatgtatgaaaaagcccactcgctgaaatttgcgagtgggcttttgaatggcacttaatgaaaaaattaaagtgcttctggaaccatcttaactggtttgttgccaatccagccggtgatttctttgaaggtatcggtgatagcatcggtgcctggcttgagcagcttacgagggtcgaagcccttgccttgctgatccttaccagcttcgatgtattcacgggttgccttagcaaaggcaagctggcattcggtgttgatgttcaacttggaaatacccatggtgattgccttttgaacttgttcttgagggataccagaaccgccgtgaagaacgagcggcatcttaacagcgtcgttcaattcttgcagacgatcgaagtgcaggcccttccagttgtctggatattgaccgtggatgttgccgataccagcagccaggaagtcgatcccggtagcggctaatgtcttggcttcttcaacgtcagctaattcgccttcgccgacaacaccgtcttcttcaccgccgatagaaccaacttcggcttcaacagaaatgcccttggcgtgagccaacttaacgatttccttggttttttccaagttatcttcaaagtcgaggtcgtggccgtcgaacataacggagttgtagccggcagcaatagcttccttggcagcttcgtagttaccgtgatccaaatgaatcacaacaggaacggtgatgcccatggctttaaccgttgcttcgatcatggtctggcagaattcatagccgcccatgtacttagcagcacccatggatgtctggatgataaccggaacgttcaattcttgcgcaccggcaaggatggcgcgtgtccattccaagttattggtgttgaaggcaccgatacagtagtgacctttatgtgcagcttttacaagctctgcagcgttaactaatggcatgtagatatcctcctaggaaataaacaattcacaaccgttgtattttatcatatgttgcgggagaaaagggcgagaaaatgatgagagctactcgagcagcgtgacggctttttataacacccgtcatacatatgtctgtgtgtacgcaaagtcactttgaatgtaccccgtaatcagggaaaatgctactgatttgctcactttttgccgacaaaataaaaaatgaccatcaaattgaaatttgtttgaaactggtagttgtgtgaccgcaatcggatatttagtcaagattaaatgagattactctcataaaaagaagacggaaatttgtttataagtggcacgtttcacaatttaaaatgctaactaatagaaaagcaaatcgcaataagtgggtatttcttaaattgggttagttgttgtatggtttgaaaaaatctgaattcacaaagtctgatctctttgataaatgagatcacactaagagcagttgaccatgccgttgaaagaactaaggtggagttgtcaataaattgataacaattgagttgtttgcatgacgaaatgcaataaaggagattttgatatggcaacaaaagcagcagatcagttagtcagtgttttgatggattggcaagttaaacacgtttttggattgcctggtgattcaatcgataccacagttgatgccttacgtcgacatcaggataagatcaagtttgtgcaggtgcggcatgaggaagtcgccgctttgtccgcagcggcaactgctaagttaacaggcggtttgggtgtttgtctctccattggcggccctggcgccattcatctattaaatggtttgtatgatgccaaaatggatcatgtcccggttctggccctgctcggtcaggtgacgacgagcaacatgaatgaaggctttttccaagaagtgaatacaccgaagctttttgacgatgtggcggtttataacaaaactgtcatggcatcggataacttaggacaaattgtcgatacggcgattcgcacagcctttacagaaaaaggtgtggcagttttaaccattccagatgatttgccagctcaaaaagaagctgctagttatcaggacagcgccgctgcttttgccttgaatgtgccgaaagttgatcctaaacagttagaggacgttgcttcgatgctgcaacaggcacaaaaaccacttgcgttgatcggtcgcggtgctgagcatgcaggtgcgttggttcaaaagtttgtcgaggccaatcacataccgtttattcaaacgatgccagcaaaaggcactatcgccgatgatcatcccaatagtttgggcaatgtcggtaaactaggtacgaagccggcatatgaggcgatgaaagcgactgatctcctcttcatgatcgggacgaattatccatatacgccttatttgccagccgaaggtcaagctaagtgcgttcaaatcgacacgcgcccagaaaacttgggcaaacgttattcagttgatgttgctgttgacggcgacgttggcacctttttcaccgaactgaatgcgaagggctccttgcgtgatgatgatcgttttctgaaagcttgccagaagaatatggagagctggaataagtggatgagcgaaaagcgcttgctggctactaatccggcatcgcctgaagcagtcttcgcaacgattgatcaaaccgcgccaaaagatgcgatttactcgattgatgtcggtacgtccacatcatggggtgcccgtttcttgaacgttcagccaacgcaaaagtatacaatttccgcatggttgggaaccatgggctgtggcttgccaggcgcgattgcgggtgctgaggcttttccaaagcggcaaaatatcagtgtcgcaggggatggtgccttcgcgatggtcatgcaagactttgtcacagcagtcaagtacaagttgccgatcatcatggttgtcatgaataatcagaagttggcatttattgaatatgagcagcaaagtgccggtcagttgaactatgaaattgatttggctgatatggactatgccaaaattgctgaagcagcaggcggtattggctacaccgctcgcagcaatgacgaattcaaaaatgcattagccaaggcatacaaagagaccgataaaccggttctgatcaatacctacgtccaagacgatgcaccgcttccaggcaaaatcgttggtgatgaagcaaagggttacatgaagtacggttccgaatatcttgagaattattggaagattccgtccatgccgccattgaaggatattatgcggcaattcttctaattttcgattagcttgtatcaaaaataaatggcttcaataaaaaatcctcactccgagtcatgtccgaagtgaggattttttttacttagagggtctcccgccaagccgccatctctgtttgccatgtcttgcgagcctcatcgccaggggacatgttgttaagtgtcacttgcgccagctgcttgtcgaacgaaacatcgaaataggtccaatagccgaaaacgtgaccggcatggctgaaccaatttggcgttttcgaatgcatccaccccataccgtagaagtcgtgggtgagggtcagtgcctcgtgccaatctttttcagacagaatatcgtggcgcaacacggcctgcgcccatttggcaagatcggttaaggagctgacaacggccccgtccccaccttggtaggcacctcggccaagcacgacaggtttaccagccgtaacgtctaggtcatcataactgttggcctcagcatattgtgtcccaagtcgtgtctgagtcatcgccagcggttcaaagaaatgttcctcaaaaaagcgtgctaacgaatcgccagtaatttttgagatgatgaaaccaagcaataagtaattactgttggagtaaacgcctttttcacccggtgtaaaatccagtggatgttgatttagcaacgaaatgacctcggtaatctcatcgccatgaccaagatcttccaaaatagggtagctaagatgggattcactggcaccaggcatgcgtttggcataatcagttagtaaaagctcggtgtaatcaggaatgccactggccatattcaacatctgacgcaaggtgacttgatcggcatagcgatagttcggcacataatctactaaggacgcctctatgtcgagcttgtcagccgcgttcaggagtaacacgctgtcagcggtgaattgtttacttagcgaacctaagccgctagttgtttgaagggtaaacggccgtttcattgaaaaatcagcggcaccattttgccaacttgaaagtatttcagtcggattcacgatgatggtcgccccattgagatggtacttttcattaatcttttgatagccttgccaatcagtcaattgatttcctcctaaccgcgccagctcaggctcttaaacgcgttcaccagcccagaaaccgggctggttcacgctctcttaaagtcggacgtcaacgccgaggcctggtcgatctgataaggttaaggtcggaccgtctgcggtgaagccgccgctaagccagtcagtttctgccagcaacatgaaactgtcgatatcgccgtagtgcacattctcgtgtgcggcgatgaagtgagcggatgcggctgttcctaggcgagtttcggcattgcaaccgaccatgcaaggtacgccggcagctgcggcagtcgcgtcaatcgccgcggcgccgaacagcccgcccgatttagccagcttgatgttgatcaaatcggcggcgttcaggcgaatagcatcggcggcatcatgggcgttgtggatactttcatcaagcatcaaggcaacgggtgactgcgcgcgtaacaaaggtagagacagcaactgccaatcaggcaccggctgttctatggcaattaaattgggggccctgagttgggctgcaattcttaacgtttgcgatacagtccaagcttgattagcatccacttttaccgagatggtggggccgactgcagcacacaccgcgttaatggcggcgatatcggcggcttcgttgtccccagcttttaactttaatgccgtgaaaccagcggccacatatgtccgcgctgaagccaccatttgagccggagtgccaatcggaatcgtgatatccgtggtgacgatatggctatgaccaccaagcagttgccatagtggcaagctggctgctttacctaaaatgtcactacaggcggtgtcaatcccacattttaatgctgtatgaccagccatcacgacatccatgcgtgcatgcacctgttcaagattgcgcggatcgcagccagttaaagcattgacgaaaactggcagagcagcttgttcggtttcattggtttcgccatttaccggtgcgtaaggcgaggcttcaccatagccggtgacgccatcatcagtctcgattttgatgatcagtgtggtgatgtcccgcaactcgcccaaggctaacttaaaaggcgttttaagttttacctgccgagggaacgccgtgattgctgtgatttccatcgcttactccttcattttagacgtggtgtctgtacctgaatctgacagacaaacattcaaaaagtatgaagcaactgtagcatcgcttgccaccgaattcaaatcaaaatctcattttgccaatctgtttgttttacgtcatatgcacaatggttgcacatgctagcggtgactgcgatgatggacttatattcttagaaggagcgttatgtcatgtcagatatatacgatgatcccgcattttttaaagcatacagccagatggatcggtccaaaaagggactagcaggtgccggtgaatggcatgaattaaaaacagttctgccagatttttctggtaaacgggtattggatttaggctgtggctatggttggcattgccgctatgctgctgagcatggcgccaaaagtgtcctcggcattgatacctccgctaaaatgttggctgaggcagcagcaaagacgaccgaccagcggatcacttatcgccggatggacatgcaggcgattgatcaattgccggatcagtttgacattatcttgagctcgctggccattcactacattgaggattacgcccagcttgtgaaaaaaatcagtgataagctgccagttggcggtcattttgtcatgtcggttgaacatccaatttttacagcccaaggcaaagaagagtgggtcacggatgatcaagggcacaacctttactggccagttgatcgctatttcgatgaaagccagcggaagactgattttctggggcaccagattaaaaaataccatcgcactttgacgacctatctcaataccttgcttgatcatcagttacggttgaatcgcgtgattgagccgacaccgacagatgaaatggttaaaaccattccggggatggcagatgaattgcgacggccgatgatgctcattgtggcgactaccaaaacggcgtatactcatgaaaaataaatcctaagtagaatagaaggaaataaatcgtgaagccaataattgggattcccacagatgaattgatcgaagttaacccagtgatgccaaacaaccatcctgcctatgcgccgcatgatttgaaagaggcttttattaaacttgatgctttgccgctgatcattgcgtttcctgatgatgtcagccagactgagcagcttgcgcaagattatgtgcagctgattgatggcctcatgttgcctggtggtccggatgttgatcccacattctatggggaagaaccgcatcccaagattggcatgacgctttatcagaaagatcttttcgaaattgcattgatcaaagcggcactggcggcaaataaaccgatttttggtatctgccgtggcattcagatcatgaatgtggcgatgggcggtacgttgtatcaggatttggaaagtcaataccctgatttgaaaattcagcatccccaagccacactgggccaatttgcgacccaccatgttgatttgacacctgatagccgattggctgccttgtatgggaagaccacgattaaagtgaactcgcggcatcatcaggcagttaaaactgtcggcaagggcatgcgggtgacagcggtggctcctgatggcgttgttgaggggatggagtcaatcgacaatgatctttttctcggggtgcaatggcatccagaaaacatgtggcaacaagaagatccgcaacaattagtggtttttcaagactttttggatcggattgctacacatcaaaaataaggatgttacgattagctcgaataacagaacaagcacctgatcagctcaaaaattctttgagattggtcgggtgcttgttttatttcgatgaaggccttggtgcttcatgattgtcgatagtttttcgggacaaggacatggtagctgctgtaaaacctgccaaattagtgacgctatttgcaaattcccccgcaacaatttttagacaatctttccttttatttaaaatcatgtaacattagggccgaacgatacatatgtaacggtgttttttaaccgggtgtatctgaataattggcgagggcattctaagaggaggaaatcaacatgggcgatgaagccgtcatcgagcagctgacagagaagcaaactgagctgatcgagtttctgtatgtggattataacgggttaacgcgtggtaaggtgattccgcttgccagcttgaaggccaagctggctgatgggattgggttgaccaaagcaaccttgaatgtcagtgaacgtgatacgattttgccggtggcggacatgacgcctattggcgaactgcgccttgttggtgatccggcgtcggcacatgtcctaccctatatgccgcaagttgccaccttaatgggggatatttacaatcttgataaaaccccgtacgcatctgatccgcggtccattttgaaaaaagtcgtcaagcagcttgctgatgctggcttcacggtcaaaatggcctatgaaaatgaattcgagttatttactggagataaagatcatcgcgaaccggcaatgccacatgtcgccttttccaccgagtccatggattttgcgtatccattcattctgaaggcgatcgatcaactgcaaaaagtcggcattatgccgaacgcttattacccagaaggtggcattggtcagcatgagctgagcatgttgccgagtgatccggtgaccgctgcggacaatgaggtgatttacaaacggatcatcaaaaataccgcgaaggcttttgacctatatgcctcattcgcgccaaagccgctagttgattcggccgggtcaggggcacacattcacttgtcactttggcaagataaagaagatgctttctttgatgacaaggcagcgatgcaactatccacgattgggcagtattttgtcggcggtgttttgaaacatattcaaggtttgctggcattgacctgtccatcggctaattcatatcagcgcttggcacctggtcattggagcagtgcatatgccacatatggtcaagacaatcgtgaggcggcaattcgcattccgtcaaccagttggggtgatccggccagctcgatgaacatcgaactcaaggcaagtgatgcgactgctaatccttatttggcttttgctggtttgctggcggcaggacttgacggcatcacaaatcacatgcaaccggatggctattgcgatgttgatccagccagtctcagtcaagctgagcgcgatgccaaagggattcagcttctgccacgcacactgagccaagcggttgacgcttttgaggcagattcgctattccagcaagtatttggcaagcaattggtcgatgcctacgcgaaaatcaagcgcgaggacgatcagtattatgccaaattggcattggaaaaaattgctgccttgcatcgcgaattgtattaaactattttgacatgatcgttgtcatgaaggctggcagcgatcacgttgtatgaaggcacttcgctttaaaacttctaggaaagcgtgagctggtcattgcaccagcaaacgtgtgaaggaggaagtattttggacgacttatctgaatttgtcgaccaagtcccattgttggatcatcattgccattttttgattgacggcaaggtaccgaatcgtgacgaccggctcgcgcaggtatcaacggaagcagacaaagattatccgcttgccgataccaaaaatcgactggcttatcacggctttttagccttggctaaggagtttgcgcttgacgcaaacaatccattagcggccatgaatgatcccggctatgcgacctacaaccatcggattttcggccattttcactttaaggagctacttattgacactgggtttgtgccggatgatccgattcttgatcttgatcagacggcagagctcgttggtataccagtgaaggcgatctatcggcttgaaacgcacgccgaagacttcatgctggaacatgataattttgcggcttggtggcaggcgttcagtaacgatgtgaagcaggccaaggcccacgggttcgttgggttcaaatccattgctgcttatcgggttggactgcaccttgaaccggtcaacgtgattgaggcggcggctggattcgatacgtggaagcattcaggcgaaaagagactgacttccaagccgttgattgattacatgttgtatcacgttgcgccgctcataatcgcgcaagatatgccgttgcaatttcatgttggttacggtgatgctgataccgatatgtatcttggcaatccgctgctcatgcgcgactacttgaacgcttttaccaaaaaaggcttgaaagtggtgctgttacattgttatccataccatcgcgaagccggatatcttgccagcgtgtttccgaatctgtactttgatatttcactgttggataacttagggccaagtggggccagtcgggttttcaatgaagctgtcgaattggcaccatatacgcgcatcctatttgcctccgacgccagcacctacccagaaatgtacgggttggcagcacggcagttcaagcaagccttggtggcacattttaaccaattgccattcgttgacctcgcccagaaaaaggcatggatcaacgccatttgctggcaaaccagtgccaagctctatcatcaagagcgtgaactgagcgtttagaaaccggagcataagcggccttaagcctaaatggccgggttttggccatttaggcttaaggtccttatgcggaggtttctgcgcaagtgaacgcgtttaaaagagagcgcgattcagcccggttagaaaccagagcataagtgggcacaagtgcgatggccgttctttggccattgtgcttgtggtcctgatgttgaggtttctgggctggagaacgcgtttaaagaggagttccttcactaatcatgcaaaaacgtaaaaaattaaccttactcgaggtattcggtctctcgatagccatggttgccccaactggcgccatgtcctttaacacggcaagtgctgccgccaatgcaggcatcaatatgcccattgctttcttgcttggtgggatcggcgtgttattcgttgcgatttcttttgtcgaacttggcaagcgcattcccggtgatgggtcagcctatgcttataatgccaaggcgcttggcgaaaaggcgggcttcatttccggctggctgctcgtgttgacgtacgtgacctttgttttcagttcgggcgccattgtcggcaattttgctgacgtgtttttaagtcattttggtattcatttaccagtcaacttgtacaacatcattgtgctgctgcttggcggctggcttagccataaaggcatcgaattctcgacaaggctaacgctggtgcttgagctgttggcggttttggtgctgagtgtcctgactgtcgtgatcattttctcaggtggtcgcagcggcaattcagttcagccgtttattccacaaccgcatatggcgaccggccttggtatgggcatggtatttgctttgatgtcttttgccggctttgaaggctcggcgacgattgcgccacgggccacccatccgcgcaaggcgattagtattgctttgctgggtgccgttagctttgcagcaattttctattttcttgtcagttacgccgaagtcatcggttttggttccgcccacatcggcgatcttgcgaaaagtaccgcgccaatgaactttcttgcgacccattatctaggcacgaacgccgcaattttcatggactttgcggcgatggttagttattttgcctgctacttcggtgcgctcaacgccggcgctttcatgctggaagctttaggcaaaagtggctatctgcatccttggctggcagaactatcaggtgacaagcagaccccgacgcatgcgctggatggcatcactggcttagcgttaatcgtttatgcgatttttgcaatcggcttaggtgtgagcgccagcgacatgtacaactggttcggaacgattggcatgctcggcttgctaacggtttacgtgctggtcaacattggcgccattgtttacttccgcaaagacaaggggcgatcaatgtttaaacatgtgttggcaccagtcatcggcattctcgtgctcatttacccaatttacaccagtctttggccgattccggcattcccgatgaacaccttcccatatatcgcgatcatctggttcctgatcggtctatgggtcgcaaccaagcggcgcaatgttgaaacgagtttggaagatttttaaagttatgacccaaaaagctcaccatttttgatggtgggctttttgattggacgtaggttgcgactatcggtcggtcgctacaacttgcgaatgtctaatgccggccttgacatacttctccgtaccatcagccacggcttggcgatagtaaccttgcttgtactcgattttatcgagggttcgttgtaggtcagccatttgggcgagcaccgtgacgtgtaactggtcaaaaaagtcacggcgtttctttaaggttgtatcgccttcaagattccactgcatgaacgttttgatatccttgatcgacatacctgctgttttcagacactcgatcatttcgagagcaccgagattctggtcatcaaaacaacgggcaccagaagcgtcttttttgagttcagggatgagtccttccttgtcgtagtaacgaatggtggggatcgatagctttgtcatcgtggcaacttcaccaattgaataagatttggacatatgatgacctccaattttttaaataatcgcttgacctaaagctaactttaggggttagggtgagtgtagcacttgatcaagcgtaaggaaaatccactcggtcacgaacgtttggtagtgatgactgggatgaaagatcaaggcagcattatttgtcgaggagggactattatgttagaagcaacttatacattagcaaatggcgtacagattcctaaaatcgggtttggcacttggatgattgatgccgatgctgatgctgcgaaagctgttcatgaagccattgacgccggttatcgccatattgataccgcggaggcatatggtaatgaagtcggtgttggtgaaggtgtgcgtgcgtctgggatcaatcgcaaagacatttttgtgaatacaaaactggctgccgaaatcaaaaaacatgatgaagcggtaaaagcgattgatgactcattgcagaagctgaacttggactacattgacatgatgattattcatgcaccgaaaccctgggctaagtacgatgaacccaatcgttattttgagggcaatttagaagcgtggcgcgccttggaggaggcatacaaagcaggcaaactccgcgcaatcggcgtttctaactttgacccgactgatttggaaaatatcatcaagcatgccaaaatcgcgccaatggtggatcaagttttggcccacatcacgcagacgccattcaaaacgattgattatgctaaggcacacaacattttggttgaagcttactcaccatttggtcatggcgaaatgttcaaaaacaccgcaattcaagccatggctgctaagcaccacgtttcggttgctcagcttggtatgcggtatctgttgcaactgggcctgctaccattgccaaaaacggtcaacccagaacatatgaaggcgaatgctgatgtcgatttttcaattgacgatgctgacatgaccacactcaagcagatgaagcctttgacagattatggtcagtttcagaagttcccggtttacagtgatcgtttgagttagtgccgacacactgctggtaatatcagaaaattgatacgacaaaatgaggtgctgataaaaagcgcctcatttttgctatccttgtggggatttatcaaaactgctcagttgattgccgatattaagcccaaggcccattaaccacgactttaccaatcatatgccctgactcaaccaaggcatgggcttggcgcagattttcggcattcaatggctgcagggttttggttaatagggatggactcgatatcgtttgctttgagttcaacaattaaatcgtgataaaacttcttcgttaacctgacgagcatcttttgaagaaaattcgcgaccaagcaatcaaaaaacgacatctattgaaaaccatttctttaaataagcgaatatcttctaggaaagcttatttgttagctatggaactttaaagaatgacattcaaaagatcaatcagatgttttcgaaatctggcgttagggtagtcattcgcgataataaaattcaggttaccggaaatgaaaaagccaaacgccgactgatttcgcatttcattatggaggaagcacctcatcatttcgttgatcgatccttgctcacacaaaactttaatcgtaccgatgttgaacagatcgagcaaattatcaaagaagaattagcgccatcaacattaaaactcaatgattatgcattgataaatctcatgatgcatttattgattatgattcaatccttacatcacgacgatacattgctatcccgcgatgcctatagttcatggctaaacacgtatgatgcggctattgtcacgaaaattattaaacgtattgagaacgtttttaaccttattttaaataaacatgagcgtgaagagatccacatgttgtttcatgctaatgttgaccatttaccgctaagtgatcgtgacaagttaaccacaactgttggtgacaacattgtgcgagcgatgagctcattatttgcagaagtccaacacatatttgggattgatctagataacgattatttcgtttttccgttcagcttgcatctcaacaaattattttctcgcgccatgcagggatccagtctgaacagtccgctaaccgaatctttaaagcaggattttccggtagtttttgagctggcagtttttgtttcttttcggcttagtcaattgttgcacattccaatcacggaaggcgaacgagcatatattgcactgcatattggtgctgaattagatcgccaaaagcaacactctgaaaaaatcagaacagctattttttcaccgaactatatgaatttgaacacgcaactgtatcagcatgtttctaagcaatttgagcatgatttgaatgttgttgccttggtgaatgacccttctgagcttgataagctcgatgtttcgctgcttatcacgacagtacctcaggcttcatcgatggcttatcgagtcgtgacaatttcgcctttcatgacgagtaaagagaaaagcaccatcatggcgacaattgaggaacatcgtcgtaacgtacaaagggattttttaagacgctattttgatatctacttcggtgagcaattcttctttacattgcagccaatcatgcaacgggatcaagttgtgaccttgatgtgtgatcaactggagcaccgccatattgtgtctccaagttttcgacagcatgtttttgaacgtgaagaagcggttggtactgcttttgggacggtcgctctgccacattctgtgtacatggaagcaaggcagacaacttttagtgtcggcatagcgaaaaactcaattcgttggggagagcgacgtgtcaatattgtcgttcttgcagctattagtcaaaatgatcaacagcgctttatgcgtttgtatgaagccttaatcacgatgttcagtgagccgcaagtggcgactgcccttgcacgtgttaggaattttgaacaatttaaaaatgtcgtcaaaacaaacatgtgaggtggcttattgccctagtttttataacatgatgtgtcagcatactgagcctaaattaaaaagtggttgaccacattagcaacaagctaatgtggtcagccactttttaattttagcgctaagaatcacatttcggccacagaacaatgctccgtacttaaatctcgaattctgcgtttaagggtagccgtgctaataccggtttctttggaaatttgttgatacgtcttaccgtgcatatgtgcatcgaaagctttcctaatttgttggtcactataaagctttttgcgaccttcatggtaattgggattatgtgctcgagcgtattttttcccttcttgtgtccgactaataatcaggtctcgttcaaattgggcgaaagccgagaaaacggtgaatatcagtttgccggtcggtgtctcgtcaatgagaccaacattcaggatgtgtatcccaacatgatgatcaaacaatgtctgcatgacatccaatgcttcacgcgtattccgcgcaaagcgatctaactttgtcacgaccaagatatcaccaaactgcaacttagataataactgtttaaaaaccggccgacccgtggtcgtgccggtgtatttttcctgataaatttcatcgacacctgctctacgcagttcttctatttgtgactcaagacgctggccttcagtgctgacgcgtgcatagccatatctcatcaaaacactcctatcatcaaggccgaattgtatcacaacttgaaagattagagccgaaagcaagaactcccaaaattatagcataaaaatgttttatggaaacaattagaattaaataactatcggtatttatcgttgaggctgtttcttatttgttattaagtggacaaaaagactggctcttaagtgtcgagttgtaagcgcaagaacaattgcaatgtcagtggctaaaagttcacctgagaggagggtaaaaatgtgacgaagatgacagctaaagtggcgagaactgggcatttgttcgcggtcttattgattttgataagcatgttaacaggcttagtgacaagtggcagttcagttgtgacagccgctgctaacattcgcccaacctatcaaaccgatgctaatggtacctatccgacaaattcgtggcaggtcacgggacaacaaaatgtaatcaatcaacgtggcggggatcaagtttcagggtgggataacaatacaatatggaatggtgatgcgactgataccacgaattcttacctgaaatttggtgaccccaataatccggattatcagattcgaaaatatgctaaagagacgaatacccccggattgtacgacgtttatttgaacgtcaaaggcaatacccagcaaaatgtgaaacctgtagatattgtcttagttgttgatatgtctgggtcaatggagtcaaaaaataatggcggcacagatcgagctggtgccgttcgtactggcgttaagaatttcttgacttctattcaaaacgccggtctgggtgattacgtcaatgttggcttaattggtttttctagtcccggctatatcggtggcggcaataaaaccactggaccgggttatattcgcgttggattaggcaaagcaggaaataccagtcagcaacaagcgattaatagcgcattgagcccaacttttaatggtggtacgtatacgcagattggtttgcggcaaggatcagccatgctgaatgcggacaccagtggcaataaaaagatgatgattttgttaacagatggtgtgccgactttttctgataaggtaaaaaattcagtggttgaaaacggcacattgtatggcactaactttggaactaccagagatgaacccggctataccgcagaacttaaaaatccgtacatcgatagttcaggtgattatatatatgatacttggccagcaacattaggtgaggctaagaaggcaaaagatagcggtaatgaggtgcacgctttaggcattcaactggctggcgacgacggctactggtcggaaggctacatgtcagacgaagatgtgcgtcaaaatatggaacttattcccacttcaccagatctatacgaagatgccgatagtgccgatgccgttgaggcttatttgaataatcaggcaaaggacattgtcaaaaactttaatactatcattgacggcacgatcacagacccgattggtacgcaatttcaatatgcgaacaaccaggcgaccgttacgagtgtcggcaagcaaactgtgccagcaagtgagttaccaagtgcgacgatccaagatggtcaattgacggtgaatcacatgaacttgggtcaggatcaggaagttcaaatccattatcaagtacggatcaaaacagaggatgctggcttcaagcctgatttttggtaccaaatgaatggtgaaacattgttgacaccaaaagcgggcgctgccgctgttgactttgggattccttcaggcagggcaccagcaactacagtttatgtgcagaagcaatggcgccagttaagcaatcaatcgttaccggatacgctcaacgtcacggtgcagcgaaaagtggctgacggttcgcttgatccaaattggcaacagaccttagtccttaaaaaagctgataactggaaagctagctttacggcacctgcgtataacaatcagggtcaaagtttttcatatgtcgttaagagtgaagatgcctcgggaattgatttgagttcgtttatcagttctcaaaatatggatcagcaaacagcaacgttgactttgacaaatcagcagtatggttttcaatttcagaaaaaaacaaccgatggtactgatttatcagcagatcagttgaaggccatgcagtttaacttaacccagtacagcgataacagttttcagcaggcatccaaaaccaacgccatcacgtcaacggatctgcaggcactagcgccggggtattacggtattcaggaagctgcagcacctacaggttatcaacttgatgggacaacgtatctttttcagctaacgtctgatgggcaatggcaataccatggcacaaaggacaatgtgacatcagggagtgttattaatggccagcagactttgaatcctgttggtgataagtcagatgattttacggtgaccggggatcaccagcaaattctgacgctaacgaaatatgatgaaccaaagccatccatgactttgcgggtcatcaaacaggataatcaaagccaatatcttgcaggtgcagcgttcaccctgcaaccaagtgctggcgaagctgagacgataacatcatcggcgacatctgagggacaagcgtttgcgacaaaattaattgcagatggtacctatacgatgtcagaaacaaaagcaccagatggctatcaaagcaatcctgcaaagattgccattcaggtagctacgactggtaaagaggcaaccgtcacgattgacggtgaggcattgaagccgggcgaaagtaagaacggatacacattagcgactgatggcagcacgatcactttgcaggcgattaatcagccacttgcaattttgccacatacaggtggtcagggctatcagcgattgcttggtatcgcactgggattgatcagcgcagcgttccttttattactggttgttttgataaagcgacgggtggtgaagcagcatgactaaatccttccgtccgttagtgattttgaccttttgcttggcactactagtcagtttggcaacgacaacgttgcagcagacacaggcggcaactgtgccgaccactgttgatgttgtgttgcataagctgttgtttaaagataccttgccaactcaacaagcaaataacgggacaacaaaacccgacttttcgcaggcagatgtgccgttaaacggtgtgacgttcacagtttatgacgtgaccgctgacttttggcagcttgtctccaaaaatggcggtgcgattgaagcagcacaaacgacgttgagtcaagatagctatcagcctgctagctccagccttatcgcacaggttgtgacggctggtcagggagaagcgtactttggcgatttaccactccgacaggggcagcatgctgcggtttatctttttaaagaaacggcggcacctaagaatattgaagccagtcagaatcttgtggttgtcatgtcaagcaaccttcaacatgggaatcaatcacgcattgatttatttcctaagaacaaaatggtaagtcgtcacaccgacgccccaaaaaaagttccaaagaaaacacgtcaattgttgccacaaacgggtgatacagttgcagcttggctttcaacgctcgggttgataattttcgcgacagtacttgcttttaacatgaaaaaacaaaaaattgataattagggagaaaagaatgaaaaagacaattgccaagaaagtgctgacattaaccagcacgatcctaatgacattactgatggttctcgggtttaatggcactcgggttcaagcagatacgaatgatacgacaacacaaaacgttgtccttactaaatacgggtttgaaaaagatgttactgccattgatcgtgcgactgatcaaatttggaccggcgatggtgctaagcctttacaaggcgttgatttcaccatttacaacgtgacagccaattattgggcatcgcctaaggattataaaggcagttttgatagtgcttcggttgccgcaaccggtacgactaatgacgaggggcaactaacccaagcattgccaacccaatcaacagatgccagcggtaagactcgtgctgctgtctatcttttccatgaaaccaatccgcgagctggttataacacgtctgccgatttctggttaaccttaccagccaaggcagcagccgacgggaatgtctatgtctacccaaagaatgttcaaaagaccacctatgagcgcacttttgttaagaaagatgctgagactaaagaagtgcttgaaggagccggctttaagattagcaatagtgatggcaagtttttgaagttgacagataaagatggtcaaagcgtcagcatcggcgaaggatttatcgatgtattggccaataactatcgattgacgtgggttgctgaaagcgatgctactgttttcacgtctgataagagcggtaagtttggcttaaatggatttgctgataacaccacaacttacacggcagttgaaacaaacgtgccggatggttatgatgctgctgccaatacagactttaaagctgataattcgtctagcgacattctagatgcaccaagcggtattctgccacacactggtggtactggcacagtcatttttgcgattttgggcgttgccttaattgcatttggagcagttgcctatcgcaagcgccgcaatggtttctaaaaagttaataagataaataagtcaagcaagagcgtcgatggcgctcttgttttgatatggcgaggtaatcagagtgacaaaacgaacacgtcgacctttaggcttgattgatattgtgattggatgccttcttttagcgggttttggtgttttatgctatccatttgcaagtgatgcttacgtttcttaccaaaatcagcaagtcatcgacaggtatcgacaacaagaagcgcggaagaatcagatggtgttgcggcgggaatataacgactatcagcaaaaaaataaacagttggcagcaagtcagcaagtgcccggcgttgccagttttaatcatgccgttaatgatcaaggaaccgcaaaaacagcggccaaacgcaatcaacaaatcttgactcgtcagacagttgctcagttgacgattcccaaaattggccttagtctgccggtttttgatcatacaagcgattggcttctacaatttggcgcctgtttattggatggtacaagttatccaactggtggtaaaaatacccatgctgtcatttcagcgcatcgtggtgtgccaaacgctgaactttttacccgagtaccagcgttaaaaaaaggcgacaagttttttattagcataggcaatcataaattggcttaccaagtctttaagcgccaggttattgagccaagtgatacccggcagctaagaattgtgccgggacaggatcttgtgaccttaatgacctgcacgccttatatgatcaattctcatcgattgttgataacgggtcgccgaattccttacgttaaggcagatgacgaggcttcaagttgggcggtttggtggaacaaattaaagctaatagtcgcacttttaggcgcggtgatcattttaggcctgatcggtttcgtaatgcgcagtttgatgcttggccgaaagcattatttgctggaagtaccggctgaagccacacaggtcgtggtgaaacgaggtcgacatatacattcttttaaatcagatcaaactggggtgactgacatcagcctgcctggtaatcattatcgagtcgtaattgtcacgccacttggccggactaagtacaaggcttatgtcaaaaaaatccgggataaaaaattcacacttaaacgatcttgagcgtacctgtgtcattagatgactcagcaactggtctatttttggtatggtgggctttgacagtgagagcattcgctacagcaacttgtgaatgatttggtatactaaagaaaactttagtgatgccagatagcagcatatgaacgagatcgggttctgatctggggaacgcgttaagggggcgaacgctatgaaacaacttgagatcgcgcatttggacaaagcttttgatcagcaagtcttgtttaaagatgccagtttcatgtttaatcaaggtaaaatatatggcttgttaggccgtaatggctccggaaagtcgactttattcaacatgattgtccgcaacttgccacatgatcacgggacgattgccgttgatgccgatgatggtcgtgggttaattactgactacgcagatacaagtgtggggatggtatacacgcaaccgcacttaccggcgtttatgacggggcttgaatttgttaactactttatgagcattaaccgaacgcgtcttgaacaagcacattcgtctgtgcaggcgaccgattttttcgaaatggctgggttgagtcaggctgatgcgaataagcttttacgcgactattctgagggaatgcggaacaagttgcagattgtcgtatcgctcatgctaagaccgccagtactgttgttagatgaaccattgacaacagttgacgtggtggcggcccatgagatgcaacagttgattgtggcgatgaaggcggaatctgtggtcatcttttcaacccacattatgcagttagcccaagctatttgtgacgctgtggtgctgttgcataaccaacagttgacagagctttcaggcttggacatccatagtcaggcgtttgaggatgccgtgattgctcggctaagtgacgaggtgcgggccgatggttgaagcgtggcgttattactggtttcaagcgcaagttgatgcaacgactatggtgaatggcctcatttattttatccggcggctcccaatattaggtaaaaagataccgactaagttatatcgtatgggtgccgtaaaaagtttgattgcgattatcatgagctgcttaatgttcatgatgaagccactgatcgcagtgcttttactagcgatggatttcttagtagccaatgcatacaacgattttatccatccgttaccgacaacgttcacatttcgtgcgatggtggcagtgacgatctatacgctgggtggcctactgtttcggggactggtctttcgttatattccagttgatttaaaagcaattaaattagctgactattttgtgctcgatcggcttgcgttggctcgtgggctgacgcgcatacagcaagtgattggcatcgtccttggaccattcttaccgttttttggactaacgatgatcacccaaaattattggattttattcgttggtttgggcgtatccgtttttagttggttctggcgcgggtttatcccacgcttgacttggtcgaaccaccggctggggatgatcgcacaaattctgtattggtgcgggttagtgggcgtgccaatcgcgctcgtgttgaccggcaagcttacaccattcgtgactggtttgttttcgccaataggcttgatcatttgctggattggggttttcgggttgtggtggtatcagcaccgcttctcgcatgatattccactgttaatggcatcgattcaacagtctgtcataactttgaacaaggtggcggcaacacagaagcaacaatttttggcaactggtaccgcgatgcagaaaaaattgacccttgatacgacggtttcggtcaaagtgaaccagcgacttggcaataactatctcaacgccttgctatttgcacgctaccgaagtcagttatggaaaaaattgcgtacccgcgtgttatggattagcggcattggcatcagcggcttgattcttttaaaattattcgcgattcactccgtgggggatttgaccccaatttacggcgccttgttcttcgtgatgtatctggcctcgctgggcggtccgattgttcagctactattcgttaactgtgattcggcgatgctcttttacccattttatcgacaacctaaagccgttttaagcgggtttttctatcgattttggcggattgttcagtacaacgccgtgacaggtgcgttaatctatggcctgttacttgcccttcaattggtgacaccagtgccggatcacttgaatttctatctggttttattgttagaagtttgcgggatggtgttgttcttttcctttcatgatttgtttatctattacctgctacagccgtttacggaagatatggaagtcgtgtcgccgttatatcgtattttatattgggcgatgtattgggttgcgtgggtgttcactcaggtccatctttccggctacacttatgcgcttgccattggggtgatcacatgcatctatgtggtggcgggcaccatcgtgatttatcgcgtggcgcctaaaacattccgtattcgctattaaacatcgcggttagattgatgctatcatcaatgtcaatctgagttgatgtgacaaagctaagcgggtactttcaatgccgatgagtcgagaaaaactgatttatcggtatttttgtgtggtttttagccagtttgcacgggctacttttgatgagcctgacgtcgacagctgtttgaacgtgttgcaagcgattccgccagcgggtacagtaggcataacgaaggaaaatattctttgaaaagaatgctaattagtttccatgaataaattgttgtcaacagggaggcaaagctgatgctaagtgatgaaaggcttcgcgggacagtgcttgcagtagacgatgatatcgatattctaaggatgttgaatcgttattttgctgcccgtcttccgacgtttaacctaatcacggccgagtcaggcgcgggtgcgttgcaacggctgaccaataatcctgatttgattttgcttgatgtcaacctacctgatactgacggcttttcgttggcggaacgaattcgggcgataacatcggtcccaattatttttctgaccgcacgggtgactgatgaggataaagttcgtggactcggtgcaggcggcgatgattatgtgacgaaaccgttcagtcttgctgaacttggtgctcgcattaaggcccactttagacgggaaagccaaccgcaaaaacgtgcacggatggcgatttttgatcagattctcatcgactaccgcgctaaacaagtgttaattggcgatcaagttttaagtcttgaaaagaagcaatatcaactagttgagctgttaagcctgaatccggggcaagtctttagtcgtgaacagctttatgaaaaaatatggggttatgacgctcttggagatgatcgagtcattacggaacatatccgccgcattcgacttctttttgatcgatatcaagtaacctcaccaatcgaaaccgtttggggagtgggctataaatggacaagttaaagcagcgcctaacgcgtttgccaataaaaaaagctttgctgcatctgattctgatcggcacaattgccgctgcattggtggtgttggtctacttgctgatttggcatgtggtgatgataccaattgcaactgccttggccaagcgctggttcattggcgggatgagcttatactttggtggggcaattattggtagttttgccatgctatacgcagtcatgaatgtcacggccagacttttttatcgtgtgaaattggggccgccattggatcaactacaatatggtgttactcatattcaggcgcaggatctggacttcacactacagccgacatctgatgatgaactcggtcaattagtagccgcgtttgaggaaatgcgccaagcattacgcaaggcgctcgaaaccgcatggcaattggctgatgatcaaaaacaagtcaacgccgcgtttgctcatgatttgcggacgccgctaactgtcttgcagggaaatctggaattgttaacgttcaatgaagaaggccagccaccagatcaacatttactagacgagatgcagcgacagcttgatcggatgaacaactttatcaaaacgatgagtcatgtgacctctattcaaaatattcggttgaatcatcatgcaatcacagaagcacaggttgaacaacagcttcgttcagaagtggataaattaccaacagccaagacgattgactggcaagttgatagcacacggtcgacagacaacaagttatcggtttcgccagacgctatccttgaggtgtttgataaccagatcaataatgccctccggttcgctaaggcaaaggtggggattcatctcaccttcaatgaccagcaaatcaccttgcaggtttgcaacgatggccagccattaacggcaactgagcaacgcaaggtcaaattgccttatttttcaaatgataaagcagcgcatcaccttggcgtgggcatgtatatctgcaatcaactatgtgcagcacatcgcggttactttaaaattcaaaaccgtgaacatgcggcgggtgtttgttcgacagcggttttcggctattttgacggcagcgccaaaagctaatgttaccaacgatgtcagaaaaatgctgaaaaaaagtattgttgtcagaatcttgtgaattgcttgttaaggtctccttgtaagctaaaggaggcttttttcatggaaaagattaacatcgaagggctcaccaaacgctatcgcggcaaggcggcgccggcgcttgatcaagtatcgctagaaattgagacggggatgtacgggctgttaggcaaaaatggtgctggtaaatcaaccttgatgaaaattctgaccacgctggagcagccgacagcaggtacggttgaagtctgcggggtgccgatcaaagcggcaaaagcgattcgtcaacaaatcggctatttgccgcaaagattcggcttttaccccaacatgcgagtcgtcgatgccatgacttatcttgcggtattagccaatgtcccagcacgggagcaatctcagcgaattcaacatctgctcgaagaggttcatttagcagacaaggcccgcactaaaataaaagctttgtctggcggcatgttgcaacgtttggggattgcacaggcgctcgtcaatcgtccaaaagttttaattgtcgatgagccaactgctggtttagatccagaagaacgcattcgcttccgaaatttgctgacagattttgcaaatgagcgcatcgttcttctatcgacgcatatcgtgtcagacattgaggcaacgaccaatacgatcggaattcttgatcaaggccggcttttgttcaatggcacaaccgatcaactcctattggcggcaaatggccacgtgtttgaaaaagaagtgtcagtggcaaagttaaacgagtttaaacggcatcgtcggattactgagcaagtaacggatgggacaatggttaagttgagatttttagctgccagtcagatcaataccagtgcgcaagttctgccaacgttggaggaggcttatctatatttgcagatgaagcatgaggaggccttcttatgaaactattttggatggaggtcaaacggcaaacaacgagcctgacttttacgatttataccttattagtgatggcatttgtgttgttaaatatggggccaatgctcgcacgcaacgttgcggcgttgccgacatcaactaatagctacgacgatatcacagcaatcgacttccagacgcgcaaaacaaacggcgttggccagttacgatacgactatcagcacaatgcttacgtcacgtatcccttggggtttgcaaaaacagtgacactaccaaaggcagatcaggcccgcgttcgtagattactgacacaagctaaccaagcagagacacaagccacattggtgaaagcactgggacaggtggacaggatgattggtggacaatcggcttacggttcacagaacattcaggggtttgcatcgcgaccgatgacaaaagccgaggcacggcaagatcacaatctgattctcaaaaaagaccgtatcagtggcacctttgctcgactatttgccgattacgccggtattgttatgggaatcctacccaccgttgtcgtcatcgcttattgttatgctgatcgtcgaagtcgtgcaacgacaagtctgcaatcgaaaatgaccagtacttggcgactagtaggcagtcgatacttagcaagtctcgtgacacttttgatgccgatttttttgatgggaatcgtcttaaccattcaaatcgctctgcattatcaagggtatcaaatcgattatctcgcgttcttcaaaatgaccggactgtggttattgccaacagtgatggttagcagcgcagtgggctttttaagtgatgcgctttttggcaattttctcggattcgtggtgcagattggttggtggttgagcacgatgatgattggtgcgcggcaagttgctggcaattatggctggttgctgataccgcgacataattcactgcataacgttgcctactatgaggctcatctaccagaattactgtttaatcggttaacctatgccgcgctcgccattggttttatttgcttagctgtggtgttgttaaatcttcaacgaggaggaaaattttatgccatcaactttgaaacgcttggtcgggttagaactcaaagccaacgagtgcaacactagtttgatcgtgcttgggtgtggcctgctcatgccggttgtttttacgatgacgccaagtaacttagcgcaagccgccatgccgggtgagttgtttctgccactgctgaccatttttgcttttggcagtctgtttttaccagaacaaacggtcgagattggcgcagtcattaatagcaagcaaacgcaactatggtggctttatctgttgcgattcatttggtatgcggtggtactggcgatgctggccacagtattgatcggcgtttatgcttttttaaatgttggggtcaatctgctcatactttggttcgactttgtcgtcaaaattttgttagttgggagcatcacggttttgagttacagcttatcgcgatcgctggcagtcgcgtatctcttgccaacagcgtattttgcattgtgtatcggttatcgctatttaggcgcggtgaatatcatgacgttcatgcgtcatcgggcagtgtctgacaactggattcagttgctgctaactggactatttttagcgatcagttttctgagtttgaaaagtcgaccgattcggggatgacagggaaaaagtttgacagctagttggtgctttagtgctcgagattagtggtggtaaggcggcgattggaaattgtgcgatagacaggcaaagagcttcatgccggttgctgctggcatgaagctctttgttaatgtttgttgattcggtgatttgtcctgatgctgctaactaactgattagttgcaattagtttttttcatgtttctttttgctcgtcaggccgatgcttagcgcaaagaccataccaaggagggcgatgcctagagcttgcaaccaatgactgttttgcatccccattggtggtagggttttcgcagctgctttagtcggatggactgattttgccggtgctttttctttcgactctttttgtttgagagccgacgttttttgatccaaagacgaggtgggttccgcatccttaacagtttttgctttgagacctttttgaacaacaaggattgtgtcatcctctttttcaactatattagatttcggatctttttgacgcgtcttgctgatggtttcctcgtcatcagtcactttggatttcggatttttctcgatagcagtcggattatcctggttatctttgtccgacttttggtcgcttactttttgatcaacgttcggttggacgggattgtcttcggttgaaggcgtggttggcactggtttagttacttcaatcgaaatagtgggttcgtcgggttgcgatgttgcgtctgttgacgaatccgtggtgtcagggtgattggttgcatggtttgagctctcgacttcagttttggtcagcgtgttttggccagatgttgtcgttgcagtgccgaactccgctgtatcgtcgcttgttttagctggtgcgatggtctcagacgaaaccttcttgtcgtcagttgctggtgtcacggttgttttcgaggtgtcgatttggctgttttgctcgcttcccgttgtgagtatttcgaccgttgatccagtggttgtgttgtcacttgatggggttgcctttggatcaattttggactcagtagcagaatctttgccagcctgtgagtcactgacggatgtttccccgatatcggggtgatggctctcggtgttttcgacatcgacgctttccgttgtggcttccggcgctttgtcagcagttggtgaggctgtggctggcgtgatgtcggaattaacggcacgatctttgtcaattgctgggtcagtgacaggcgactcggtatcagtggacttatggctttcgactttttcgactccggtcgtttccgtgaccgtttcaatggccttgttatcaattggtgcgattgtcgttgcgtccatttccgacttaacggaattatcttcgcttgccttcgggtctgcggcaactgttgcaatggtaccagctgcagcctctcgattgtcttcggctttagcctcttccacggttgtttcatcgatgttgtcttcgtttggtgtgattgctgatgcgtttgattctgacttaatggcacgatcttcgtctgtttttcggtctgaaacggttggttcgacatcatcggatttgttacttttatcatgttcacctttggcgtcttccgcgactgtttcaccgacctcggttttacttggcgcggttgcctctgattcaatttctgacttagtggcacgatctttaatcggtttcggatgagtgtccgttgtttcaaccacattgacttgattgtctttttcatcttcggttggtgtgttttcctttgttatttcagtggctgtggccgtgttgctgcttggcgtggttgccactgattcaatttctgatttaacggtaccttcattgtcatcttctgtgtcggtaacagctgattcaacagtatcggttttattacccttatcatctttgacatcggcattttcctttgcagtcccagaagatgtcgccgtgttatcacgtggcgcgatggctgttaaatctatttcggactttacaccactgtttttggccatagtcggggcgatattcgtttcagcagaatcagatttactgcctttatcattttcggctttgctatcttccatggctgcttcaacagctttgtcgttactttgcgaacttgcagctggatcgatttctggtttaacggcactatctttgtcagtcgttacatcagtgatagccggttgggtgttggcggattgatgaccttctttttcagcaattttatcgttttctatggccgcttcaacagctttgtcgttactttgcaaacttgcggctggatcggatttaggttgaatagcactatctttgcttgtcgtgaggtttgtggcagttggttcgtcgtcatcagttttattgcctttgtcctcattgactgtggtttctgttgcggtctcaactacttgactgtcaggtagtgaggtcgctgttggatcaacttccgacttagtggggctctctttgtccatcgtcggatcagtgtcagtaggggcagtggttcctggtgtgttgtctttggtgtttgttgcttcagtggcttcggcgtcagaatcaacgcccttagcgtgattcggcatcgttgtggttgcattaggactgttatcaactggattttcatcaacagctgttgttactgatgctggtgtgtttgttgccgtgtcatcgtttccgtcactttgagcttcctttgatgtatctatttcgacaacggggttacttgtttcaaccttgctgtcttccggattgaccatcgttggctcggtgcttggcgtcacctcagctttttcatcgctggatgatgttgtgaccggtgcttcacctgcatcattcttgggtgtttgatcttcttgttcaggagtaatttctagttcatccaaggattcttccttgagaagttttggtgtcttagtgacgttgaacgttttcgttaccgtgttgccaacttgatcaactgcctgtagggtaatgatattgaggccatcggttaattgataggtttcgtcaaacgatgctgcaccatatgggttgtacccgtttgtaagttgattcggcgcggccgaagattgatgtgcattgaaacccgctagattttgctgcgtgaagatgttgttaccattgctatacaaacgatagccgccgatattgtcagtcacactcccctaattgaaaaggtgtcagcgtccgtggtgacaaggtaggttccatcatcgtcaattttcattgaatcagcatctgaaagctccagtgtcggcaaggttgtatccatataaagcaacaggaagccgccattggtcttctctttaccgtctttatcgagagttgtgaggacatagccaatattccgctcctcagtcgggttgcatggcatggtcatactgaaagaaccatctgctgcaaaggtcacttcattttgaggatcattttgtctcggggtgacaaaaatgcgtaacttactgtttttcggatcagataccttgccacgaagcgtgagggtcttaagcttggcgtcgtagaaagtgctggcgctgtcaatgcctaccaatgttcgtttgttgttgttcaggtcaaggaatgcaatgccgttgatcatttttccttttgtgctagttagaggtgaacgtcctgtcaggtgggcagcaccagaaaagaacttagcgccttttatggcggtggcttcgtcagcaaacggtttcgtctgggtttttgcgtttgagtatgcagcggcgttcttcttgatgaaaatgatgaagtcctctgttttaggggatttgatgaactccccaaaggcatctctagcaatggctgagatagtcaggttagcatacggttgaccggtagcatcaatattgaaggtaacaatacctgtggctttatcgagcgtgccaatgtattgacggtcactcacgtaatctgtggcagtgacaatatagtcttgcccttttggtaccattgcctgggctgtaaaggtgctgtctttagtcaaagcttgataacgtccatcagatcgcgtcaaatttcctttggtgtcaggcattgaccaacgaacttgcggccaaataaaattggactcaatggttttgttttctccgacaacggccttaatgctgccttgatcactgttgcccgcggcatcagtgattgtcaaagttaccttaccctcacccgtcttcagattggcaagttgatcatcgttcagttgataattgattgtgcctgtagttgctttgttgtcgtgatttaaaggaatgccataggttgctgaaccaatggtgagtttggcttgactatacgcggtgaaacccacgccttggtcgctatagtcagccgttagcttgccgtctgagtaagccaaattggatagcgtcggtttaatcgtatcgacggccactggtaagctcatggtttgcatgttattttcgcctggtgtataggtcataccgatcagacgataggtgtaaataccatcctttgcaggcaccatttgaccggtggtttgatcatagacttgaccgtcccatttgagcttatcaggattcagaaacattgagattgatttggcaagatcagcattggtagtgctgccgacctcaaggaaagacttggtggtgtcagtttcttgatcaatgacccgcattactttgtcatcttgatctaaaatctgtgcaatcacttgtttaagattttgcttggtgaagacatagggggtgatggtgtcagaaatgccatcgccatttggtgaaaaagcgactttgttgttctgaactttggccccaatcgtttgccaagtgaaaccattcgtcgggttattgactagctcgctcagcgatgttggatcggtaatgcctaatggattgtggttgttatcgacaaggtagccacctttaaagatactgccttcttcgtttgcgggcttgtcgaacacggcctcatcattggtggaaccgtaatatcccatgtagggaaccgaaatggattgacggtcatcggcggctttgaatttgataaagccttctaccacttgatttaatttaaccgtgtcatcaagcgaaagggtaaaggtgatctttttgaatgccccggcatcaagcgtgaaagttggcgtagcagttgtgagggtggcaccaggcaatgtgcgatcatgaacggttttgttgttggcggtgtcaatcacttcggtagcaggttggccaagatcaagcgtgtacgtttgctgatcggtaccgcgattttccaacgtaatgacgaatgatttgctaccggtgaattgttgtaatgaaacagaaccggcatcatcggtgccttctgcactgaccgtcaaatttgcagcttttgcaacatcgatttgacctgcgccttgacgccgaggagagatgatttgtccagggtaattgatatcgagtattgggttagcggcattcatcaaggctagtttcactgccttcacgagttgcgcaccagttaagtttgtactgcgtttcagattttgcatcaccagtaagctggcaccggtaacataggcatttgcctgtgaagtgccgctcacttttccaagtccatcattcagtaaggtagaggcaactttttcaccaggtgctgtgatatcgggttttaatttgtaggatgctgttggtccccatgaagaagcggatatcaaagcggccttagcatccagaacatcgtttccggcagcaaccgccatagctgatggcgttgcgctaggtgtcgtcaaagttgaagcattggcaggctgataactggttgtgatcccatttgaagcggacttgtcgtaaatacccccggcgtgaccattattgccggtagctactgtcacaaaaacaccatgatcggttgcaaatttaatggctgcctgtccttcagcggtaggatcatcaatatcgacgcccatgccaaaggaaatattgatggcattcgcacctaagtccactgcatcatagatggcccgcgcggcattattgagtgagtcagaactggacttgcctagtattttcatgctgagaagctgggcttctggggcaatcccagttacaaatttctttgaatcactaggttgaccattggcagcgatgataccagcgagatgttgaccgtgattactcgtgtcaaattttagattttcgttgacgttattggtgtaatcgtaaaagaatgggatcttttcattgacataatcgccatagccatgacttgcagtgaatgctttgatttgatcctctgaaagtgcagccgttttggcatcactgagtcgaaagtcttgatgtggctcaacaccttgatcaataacggctgccaccatgccttgacccttgatattttgatcccagagaggttgaacattgcctttagttagactggctttgttttctgggttgaatgttggggctggttttgcaattggagctggttttgctggggctgctggcgccttttgtgcgggctggctaactgttttttgagcagttttggtattggttgttgtcggggtggagggggtgaccgatgtcggttgagtaggttgttttgctttagccgatgcttctggtttagcctgtgacgatactggtgctggtgtagcaggtttcgcagtggctgtcggcgttgcacttgcagctgttgttgttggggtgttggctgaggacgttacttgtccagtggtcgtggatgctggcttgctgacgggtaagtcagccgatgccgcgtctggcgctgcttgattagattttgtttgggttgtcgttggtggggtagtggcatcagcagaaacaccttgagcaggttgcatcatcagaaaactcgctgcaccaaaagtcacaatggcactgtagacccaatgtcgccctgacttatacattttgtagcggcgcttttcctgtgaaaatggcttgactctgttcatttttatttcctccaatggtatttaaagcagtcggtagtaaccggcgccatcagcgatatgtgtgtcaataagtgatccagtgaatccttgtttgtaatttaacccgttataaaactaatgtcaatcataaggtatagaaaattaacctggtttaacgttttatttagttattactgtaggaggtgaataattaaacaattataaaaatattcagataggtgtttaacgaaatggctagatttatttaacgatggataatcataaaataaacgaatcaactaaattatttgtgtgatatagatggataccatatgcgtatcacgatgaacagacacttgttttatgacaggcgttgcgcgaactttaaaaactttcaatcagacagaataaaaatcaatgccttcaatcaaaaattgggttcaatatcaggttcactgttacgaaaaaatgctaagtgctgtttccagcaattagcattttctcttggctgagattgaaggaatactgaacacaatagtttttgtggacggctttcccctgtttaagaattgaccttgtgtttctcgcgtttcttcttatcagtgacaactatccctagcgttgtcatcaggctgatgatgatgacccctagaatttgcaaggcattacgatgcgaattcgccatttgtggcaacttggagctgacaccggattgagcgtcgtttctggtactcatggcaggtgttggggctgcgttgattttggtggctaggtcattgtcagtggtagcatttggtacagtgatctttggagcatcctcgtcaccaccattagcggttgattcaaaggaatcctttcgctcggttttgatggcagcgtgcgcactgacttccttttcattatttttgtcgtctttaaatgctctcttagcttttggttcagtggtaagttctgtaattgccgattcaatgccctctttactaggcatttttttcttcccattttctgttaaaacagaagcgaaggcagcgccaatgtcgatcttctcgtctgcggttgctgtcagagcggtatgactggcgttaactttgtcgcttgagtctgtgtcggctactgaatcatgagcttcatgaatgaccgcttgcgaagaagtctcaggtttagcagctttttcttcgttgatatcttgaggcactttgtcattgagaaccgctgttttcacgagggtatctttgacttcagtgtcagtcactactgaagaggaatcatttttaggggtagtagcgtcatcaaaagagacattaccttgagcgtcttcgatactgtcaacagctgatttcgcatcattggtgtcttcaactgccttatcatcattgggggccacttcacctttagatgcttcggtttcgctaagggcttcctgcgaagaaatatcatttgtagcatcgttgtcctcgtttgaagtcacgttgtctttagacattttggcatcactaaggaccgcttcaaaagaagtatcttcatcaccatccgaagttgtctcatccccaggttccttggcttcacttgaagtcacgttgtctttagacattttggcatcactaaggaccgcttcaaaagaagtatcttcatcaccatccgaagttgcctcctcctcaggttccttggcttcactgaaaatttcctctgccgagatatcgttttcaacatctttatctccgtctgggaaaatgttttcgtcagattctttggcttcgctaaggactgcttccgaggaagaggtctcttcactgtcgttgccgccatctgggactaagtcatctttagctttttcaactaaatcttcgtcaacgacatgttctacaaaggcatcttctgcagaatttttgacttcacgatcttcactttgaggatcccgcgtatcatcagaagccatttcagcactagcgtcagtcgcgccgtcgccgtcattagccgattccgtgcttgaactttcaggactatccgtcaccgtttgatcttcgagatcagactcagtcggttcagaattttccgttacagcaactttcttgatcttgaacactttgacggtgcggttgccgacttgatcgacggcttccaacctgacaatgctcgtaccaacgggcaaaatatatccgcgcttaaacggcaccgggtcatatgggttcgttctgtttgcgcctgcctcagctgttgccgccggttgatggatgttgaaaccagcacgagcatgctgggtgaggacattgctgccgttactgtaaagccgatagccatcaacgttatcgtcaatggtgccttcaagggtaaaaatatcggcactggtttcggcggtgtaaaccccgtttgcgtcaacggtcatgccatctgtgtcactcacggtcaatgttggtggtgttgtatctaaaatgatttgaaggaagccgtcagtggtcactttctgaccagttgcgttaatggtcgttaaggcataaccgacgttcttttcttcagttgatttgaaaggaaccgtgacgtcaaacgaaccatctgctgcgaggattgcctgattttgcgggtcactcggattcggcgtggcaaaaatctgcaagtcggtatgcgaaggatctttaatttttcctctgatgtgaagcagttgatgctcggcatcatagcaatgactggctttgtcgacacctactaaagtcaagctgttgtcgttcagatcggtaaacatcaaaccgcttgttggtatggcgcttagcaagttgtccgagaatttccgccccggcaatggttcggcactgcttaatcgcgttgcagcgtttttggccgttgcttcgtcatcaaagctttcagttttggtgttgtcattgctataagcgccagcgtcaggatcgtggaaaaccaacagcgaaggaatagccggtgatttgatgaaggttccgaattgtggctcataaagcgcataaacgtctaggttggcatagaagttggggttttcaacatcgaaagtagcgatgccggtggtttggtcgcttctttcaacatagacattgccggtgacactatcttttaaaacgacaagataatcaccatctttaggcaccatcacttgaaccgtgtacttgtcatctttggttctgatttcataattgccatccattctgagtccgttaccatgaacaatcggaattgaccagcgaacttgtggcgtcggcgtggtgtccacttctggcagatactcgccggcaactgcttgaatcgtctgacggctgctgttgccggccaaatcggtgatagtcagcgtcagtttgccatcgcctgcctccagcgcgtcaagttgatcgtcgcttagctgataggccacggtaccggtgtttttagttccatcattgccaagagggacttcataggttcgcaatccgatggccaatactgcggcgctatattgggtgaagccgacaccttgatcttcgtaattgaaggtgatgtcgccattgtcataagtgaagtccgtgatcgtcggtttgacggtatcaatcgcaacagggagattaataccttgccgatttcttatcccagcagtataggtggtgccaacaaactggtaaacatagcgaccatcttcggcagtcaccaacttgcctgttgctcgatcataaactttaccgtcccatttgaaaccatcaggatggtgccgcatactatcagacaaggtcaaatccgtattatagttagtatcttgcacgtaatgtgacttagcggtgtcattttcaagatcaatgacccggacaagatgaccgtctgtgtctagaatttgggcggcgacctgttgaagattttgtttaacaaaaatgcgcgggatgacggcatctgaaaccccatcgttattgggggaaaatgccactttattgtcttttgcagaggcggcaacggtttcccaattaacgttataactaccgctgttaacaatgtcgcttaaggtgagcggatcggcaatgcccagtgggtaattattttcatcaagcaaatagctgcctgtaaaagtacttcgaccttcattagcagcattatcaaagacgacttctgcattggttgagccataaaaacccatgtaaggcatggaaatggattgactgtcgtccgcagctttgaaggagatgaagccttcaatgacttgatgcagccggacagtttgatctagggtcaacgtgaaggccacggtttgtgacgcgcctgctttcaaagtgaaagttggcgttgcggttgttagtgtcgcacctggcaaggcaacagcataaatgccattagtgtgggcggtgtcaaaggtttgcgtgaggggatggccgggcacaaccgtataagtttgatcggttgtgccgtggttggtcaacgtgatagtaaacgttggtgctgcctcgaattgttgcaaggaaacggaaccggtttgatcagtaccttctgccgtcaccgttaaaccgctggctttggcgacatcaatttgaccagccccttgacgtcgtggtgagacaaagttgcccggataatcatgatccatcataggggcagcagcattcatgagcgctaatttgacagctttgacgagttcagcaccagttagcttagttgtttgcttgagatgctgcataacgagtaagccagcacctgctgcataagcactggcagccgcggtgccgctcttggtcgctaacgtgttgtttttgccaatcgagacggatttttcaccaggtgtcgtgagatctggtttcagtttatagtcagtagttggtccccaagacgagttatacgccatggcggatttagttcccagtgctgaattttccgaagcaatagtgagggcactaaggccgccacctgtcagcgaaagcgtgctatcatttgtcgtgatataaccagccgtagtgccgccggggacggaggtgccgtgaatcgccatggcattaccgttgttacttgtggttttgatgacaaggacgccatgatcggtagcaaattgaatcgccgcttgatcttcagcagtgggatcttcaacatcgacagtcttgaccagcgatagataaatcacatctgcacctagcgcgaccgcgtcatacaccgcacgggcaacgttatttgtggtcagtgattttgcttggcccaaaaccttcatgcttaggatctgtgcttccggcgcgaccccgaggatatagcggccatctggtctttcttgtccattcccggcgataatgccggctacttgttcaccttgaatatgattatctaaatgcagattagtattgctattggtggtgtagtcatagaaaaaaggcagcttgtcattgagataggtaccatagccgtgactagcagcaaagtcggcaatggtttcttttgaaatcttggccgtcgtgttgtcgcttagtcgcaacatatcatgcggttcaatggcgctatcaatgacggcggcaaccatgccttgtcctttaatattttcatcccaaagcggttgcacattccctttggttaaaacggcctgattaatcggtggtttggctggcgcaggtgttggctttgtttggaccgcagatcgcggagaagcggttggcgccatgactggtgacgctggtgtttcaacaggcacagtgactttaactttatcggttgcaacaggtgcagtttttggcgtagcggttggtgttgctgatacgatcgatgcggcatggctgtcaaacactgccttcgaatggtcagccggttttgttgaaggcgcttcgacttgattggccgctgatgttggctgagtttcaattgcgggggccgctggtttgtcaacgctggactgggggttatcagtgggagtcggtgatgcggtaacgggctgtttgtctttgagttcggtatgcgatttggcaagcgtcgtcgcgctggcagtcggtgatgcttcatcagcaaaaacggtttgcgttggctgaaacatcagaatgccagctccgcctaaaacagcaatggcactataaatccaatgccgtcccgccttatacatcttatagcggcgtttttcctgtgaaaagggattcagtttgtacacgttatttcctccggtagtcattaaaacaaaatcttgaaaagtgagttgtagcagctctagagaagcgagtgtcttgctcattttctctcatgtctgtaatttatccttagataaaactaatgtcaaccattagaaaaataaaataaattggttttagtatgttagctagttgttaaaataaacaattcgcattatattaattgacttttaatcgacaattgaatttctaaataactgaggatcttaaaggttatttagcagcatttaaaaattgaattatcgttaatatctgcggacacgatcagttgagaaacggcctgacacgcaagttcaataaccgtattttcacgcatgtaatttttttaagtcgctgagccgatttttggcgaaaagaaataagtctgtcgatttcaaccgacaccgtgagcttttcgatacttggcaaccccgtaaccgtctggcttggcgtataatgagcgtaatcttacaattcgaggaggaaattatgactgaagcaacgcatttttatcaggcatttcaaccggcacattatgagctttacttggctattaaccgggcaaacaaaacgattaccgggaaaacaacgattactggtgaggcgaagcaaaccgcgatcgcccttcatcaaaagtatctgaaggtgagtgcccttcaggccgatggtcaggatgtaccgtttacgattgatgatcctgcagaagcgattcgcatcactttgccccaatccggaaaggtgacgctgacgattgactacacggcaccattgacggataccatgatggggatctatccgtcttattacgaagttgatggagtcaaaaagcagattattgggacacaatttgagacaaccgctgcccgtcaggcttttccaagcgttgatgaacctgaggccaaggcgacatttgatttggctatcaaattcgacgaacagccgggtgagacgatcatcagcaatatgccggaaattcgcgaagaaaatggtgtgcattactttgacaccaccgtgcggatgtcgacttatctgatcgcgtttgcttttggcgatctgcaaaataaacaaaccacgactaagagcggtgtgaagattggcgtttttgctaccaaggcccacaaaccaaacgagttagactttgctttggacattgccaagcggtcgattgaattctatgaagacttctatcaaaccccatacccattgccgcattcttggcagttggcactaccggacttttcggctggcgcgatggaaaactggggattggtcacctatcgtgaagcgttgctgacgattgatccggacaatacctccctcgaaaccaagcaacgcgtggcaacggtgattgcgcacgaattggcccatcaatggtttggcgatttggtaaccatgaagtggtgggatgatttgtggttgaatgaaagtttcgccaacatgatggaatatgtcgcagtggatgccttgcagcctgattggcatatctgggaagctttccaaacccttgaagcaccaatggccttgcaacgtgatgcaacagatggcgtgcaatcggttcacgtgcaggtggaagatcccgccgaaatcgattccttgtttgacagcgccattgtttatgcaaaaggtgcgcggatgcttgtcatggtgcgagcactgattggcgacgatgcgcttcgggctggcttaaaagcttactttgaagctcacaagtttggcaatgcagccggcgctgatttatggacggcattaggtaaggcgtcgcatctggacgttggcaaaattatgcagtcatggttggagcaaccgggctatccagttgtcactgcagctgtggtggacggcaagctgaccttgtcgcaacagcaattcttcattggtgctggcaaagatgtcggccgccagtggcagatcccgctgaatagcaactatgctgtggcaccccaaatctttgccgagaaaaaggttacgcttggcgactatgcgcaattacgcaaggaaaatggcaaaccattccgcgtcaatgttggcaacaactcgcatttcattgttcagtacgatgaacaattgatgaccgatattctagccaatgtggatcagctgaatgcgattgaccagcggcagattatccaagacctgcggctgctagctgagggtcgtaagaattcatacggcaatattgtgccattgctgccgcggtttgctgcgagccacagcgcgattgtcatggatgctttgttccgcgtagctggcgacttgaagaagtttgtagcacctgattcagacgctgaaaagcagttacaggcattctttgacaagctcagtgctggacagcttgatcgccttggatggacgccgaaagctgatgaaagcattgatgatcagttgacccgtccatacatcctgagcatggcgttatatgctaagaatccagacgcgattgcgcaaggacatgagttgtttacagctaatcaagcacaattggttgctttgccagctgacatccggatgttcgttttggaaaatgaagtgaagcattttggcaatgcagacttatttgatcagctgctaaaagcctacacgcaaacgacagattccagttataaagctgatattctggctgcgttgaccagtacaactgatccaacgcaaattgccaaattggttgataagtttgaggatgccgacacgattaagccacaggatctgcgttcatggttccgcggggttctgaataaccatgctggcgagcaagctgcgtgggactggattcgcaatgaatggcagtggcttgaaaaaaccgttggcggcgatatggaattcacgacctatatcactgtgatcgctggcgttttccgtacgcctgaacgattgacggagttcaaggccttctttgaaccaaagctgcaaacaccgggtctgacgcgggagatcactatggacaccagtgtgattgccagtcgcgtcagcctgattcaatctgagcaacaggctgttcaggctgctgtggcagaagctgttaagtaaagatttttaatccaatatctgcaaaccgtcactttgaaaataggtggcggtttttctgtgtgacatgcaggaacataacttataactgacgaataagggcgaataactatccgtattgggtagtattgcgaaaaatatcataagttgtttgacttttctgtttcatgaataatttgatggggtatgaagacaccagtgccaaggcggagctgtcgtaggccagatggggctcagccgtgcaaacaacacagcgactgggcttgtcgctgatgttgttaggcgacttcgagaccggtttttgggctcgaagcgccgtcacagctctagctacgcgtcggcagccccatctgaccggagattgcggagtttggcacggcatggcgtctttagccaattgattttcctgcgattgttggccacgaagataaagcccaacgctcatttcacatttttcatagcttataatggttaattcacaacgttaatttaagaaaaatctaatcctcatctatacaatttcacgggaaagaaaacgggttaaaccgttacactgaaaagcgagtcgctgttgattgatggacaggcggctgtttggagggatttttagtggcagatacaaagaaacaactgcgctggtataacgtggcgttaattgcattcgtctcggtctggggcttaggcaatgtgttcaacaactacgctcagcaaggcctttccgtcgtgacaagctggattttgatcatggcgatttactttgtgccatatgctttgattgttggtcaactcggctccacctttaaggatcaagccggtggggttagctcgtggatcaaagaaaccggtacggtcaggttggcctattatgctgcttggacctattgggttgttcatattccatacttagctcaaaagccgcaagccattctgattgcgttgagctggttgtttaaaggcaacggcaatttcgtgaataccgtctcttcaatgaccgtatccttaatttgtttagcactcttcttgctatttttatggctgtcgtcacgtgggttaaccactttgaatcgcatcggcagtatggcaggtacggcgatgttcttgatgtcgattttgtttatcattttggctgtcactgcaccgctcatggtcaaaggcgtgcatgtggccacaccggatatgggcgacattcatacctacttgccgaagtttgatctgaattacttcaccactatttcgatgctggtttttgcggttggcggcgcggaaaaaatttctccgtacgtcaataacacgaaacatgcggccaaggaatttccaacggggatgctagtgcttgccgggatggttgccttttgtgccttgctcgggtcatttggcatgggcatgttgtttaacagcaaccagattcccaccgatttgatggccaatggaccgtataccgccttcgcgatgctgggcagttattatcatgttggcaatattttcgtcattctctatgccatcgccaacgcgctcgcttccatttcagccttagctttttcgattgacgcgccgctgaaaatgctgctaagtgatgctgatccgcattttattccaaagaagctgagtcatctgaataaaaaaggcacgccgatcaatggttactggctgacagggattctagtcagcttgctgattattgtgccagcgcttggtattggcaatatgaacgagctgtataagtggttgttaaatctgaactcagtcgtgatgccgttacgctacttgtgggttttccttgcctattatttgcttaataagcatttggaaaaattccaagcagagtacatgtttgttaaaaacaaacacgtgggcatgattataggcggatggtgttttctttttaccgctttggcctgcttgttgggaatgttgccgaaaatcaattatctcaacgatccagggacttggtggttccagatgggcttaaacatcattacgccagttattttcctggcattgggacttattttgccgttcattgcgcgacgggatgaagctcggttactttagtaaataaaaattgatcatagtaaaaaaagtctgtgttggcatgccgaaggttcgggtgtcagcacagactttttagttaacgcttttacattgaagctgaatgcatcacttaattgccgcttttttcgcgcagcatgtcactgatgacgatctgattgaccgtgttccaaaccatgtgaccgactgcttcggataagtgttcctcaaccggttgatctttagcggcaggcacaattttcagtgccggcattgcccacaaatgggcacctgcccaaacgcccaggccccacatactgccatagccaagtttaaaaagcggtacataatggccggcgacagcataaagcgcaccgaggcttgatgagaagccgaagtgtatgaggaggctgacccaaggaatctgatggtctgaataagtgtaagttgcatgggtttgtgctgcggtgagaccgtgttgctgcaggaatgtttgcggcggattggttgcgtcacgttcaggtgtccgcggcggcaaaatattttcccagcctaatttgacaagtcctgatactaaaccggcaacggcgccaaccgcggcaagcttcatgacagatgtttttgtttgtgtacgcatgcaatgacctccttgaaaatgtcttgaacacttccattttagaacagcgacaggcatttagcatggtccgatcttattagttttggctttccgttaaaatggcgcgaacttgattagtgcaccgcagcctttaacgaataatagcgccagactattgacctgatgcgtcaggcacactttactggcgaatgtccgcatgatgggcatgaacaaagtcaatgaagtctttggcggctggggattggtagtgatcttttaaagttgccatataaaaaatacgctgccaagttggaaaactaagcggaatgattttaacgggtagcgttttaagaagtggcatattggggacaacggcgatgccgaagccgtttgcaacgagacccgcgacggcttcatcctcttcaatggcgtacacactgtgtggttggccgccgcattcggcaaaaagctggcggatgatgggcgcgaggccgcttcttttggagaaggtgacttgatcgaaggccaaggtttcactaagttcaatctggttgcgagtagccaagggatgatcagtcggcgtgatcacgacgagtgcctgagaagcaattggaaaataggcaatatcctcttgctcgtcaacttttgagcaaaagcaaatatcataatgtttagcgcgtaaaccttgaataatttgtggtgatagcccgttttcgttcgtgaattcaaaacggacatcttgttggctgttttgtaagaattcgcgtaccatgccagggacccagcgtgtgctgagggtacgtaaggcggccagtttaatcaccgtttgctcgttgttttggtgttgcagctgttcaatgccgctatcgaggatggttagcgagtgatccacaatgcgactgaactcgcggccttccgaagttaaaacaacgttgcgtccttgtcgcacaaacaaggcaaggcccagttcggcttcaagaccatgaatggcattgctcaggctgggctgggtgatgtttaactggcgggcagcacgggtatagttctgtgatttggctaatgtaacgaaatatcgcagatgaaaaaggttcattttggtcctcctatgaaggcttaacctgaacgatagcctccagctataagcaccctcattataatgaattagaagtcgcttgtgcaaccgtatacaattcaatttgtaaacaagattgaaaaattaatcacaaatcattttgggaggcactatcatgacacttactcatccaattaccgttagttcatggacattaggcgaccaatgcaaattcgaagatcgcgttaaagcagccgcaaaagctgggtacgatggcatcggcttacgcgccgaaacctacgtcgatgcgctgaatgaaggcttaactgatcaagggattctcgacattcttgatcagtatcatatcaagtgcaccgaggttgaatacatcgtgcaatggtgtgaagaaccgcggacatacgagcaaaaatataaggagcaaacctgtttccatatgtgtcacttgtttggcgttgaacatatcaacaccggtttgatggaaagctatccagttgacttcacggccaagaagttgcaggaactggcacatcgcgcagctttggctggtaatctcatcattgccctcgaaccgatgccatatagcggcatgccagatttgaagaagacttgggcgattctccaaggcgccggtgctccgaatgtgatgatgttgttagacatgtggcactgggttcgagcagaccagccgttcgacttgctgacgaaggaacaagctaagcgcgttatctcaattcaacttgatgatgcttacaagcggccatatgcaaagtccattttgcgtgacgagtcgatgcacgatcgcttagcaccgggaactgggtttgaagatcggactgaaaagtttatcaagatgattaaagaggctggcgtggatccaaaagtgattggtgttgaagtcatttctgatcactacatggccaaagggattgactgggttgccaaatatacttacgacaccacggtgaaaaccttgcaggcggcatggccggaaattttgaaggaaactgttgcgacacactaaaaggagcgtaatttttatggctgattggttaggtttgaaagacaaagttgtcgttgtcactggtgctgttggcggtatgggcactcatttttgcgaagcctttgcagagcatggggcgaagcttgtcttggttgatattaagaaagatgcgattcagacagcagctaagaagttagctgatcaatatggcgttcaaacattagcagtggcaaccgatacgacagatgaagatgaagtcgatgctgcggtgcaagcggttgtggctgagtttggcaaagtggatattctcgtgaacacggccgctatcttgcgcttttcaccgtttgaggacttgcgtttggatgagtggaagacggctgtgaatattaatttgactggttatttcttgatgtcacaacgatttggtcggcaaatgattgcccaacatcatgggacgatggtgcatatttcaacggttgcggctgatttcccagagacatacagcggggcgtacagcacaaccaaagctgcggtcaatatgttatcgaagcaaatggccgctgaatggggacagtttgggattcgcagcaactgtgtcatgccatgtctggtgaagaccccgatgtcggctgatttttacaaggatcctaacgtgttggacggccgtgagcacttagttgccagtcgccggattggcaacttggatgacatcgctaatgctgtcctttacttgagcagtgaccgttccgattacacaaacggtgatgaactgcgagttgatggcgggctgggcatcatgatgcaagatatgattccgaagccgggtggtcggcgtgaatacgcgattaaagcgcaccaagctgccaagtaatttgcaatattgatagaagcaacttgatcgcaccttgggtcaggttcttcttttcaaaatgctcgtgaaaatatgaacttaatggaggcactgaacatggagacgtggatttctggaacgactggtttgttgtgtttgctgggcagtccggttggtcattctggctcgccagcaatgtataacttcagttttcaaaagcaaaaaattgatgcagcttatgtggcgtttgacgtgaccaaggggcagatgccagaagcactgaatgccatgcgccttttcaaaatgcgcggcggcaacgtcacgatgccgtgtaaaaatgtagcagcaactttgatggacgagttatcgcctgctgccaagatcattggtgcggtgaatgtcgttgtgaatgatgatggcaaattgatcggtcacatcacggatggcatcggatttgttcggaatttgcaggaacacggaattgatatcaaaggcaagcatttggtggtattaggtgctggtggcgccgcgactgccattcaagtccaagcggcgttagatggtgcgaaacagattaccatctttaatcgccaggatgaattctattcacgtgctgaatcgaccgccaagaagttggccgaggcagcgcctgctgtcaaagtagatgtggttcagttggaaaatactgacaggctcaaagcagcgattgcggacgccgatattcttgtcaacgcaactactgtcggcatgaaaccagacgatggggtttcccttgttgatccgagtttcctacgcgcagatttggtggtggccgacacggtatacaatcctttgaagacaaagttgattgaagatgctgaaaaagttggcgcaaaaacagcaccgggtaaaggcatgctactttggcaaggcgcagccggatatcaattgtggactggtcaggacatgccggtgaaggcatatcaggcatttgaagaagagcgtgaaccagaccggtctctggtgtagggaacacgtttaaaaacggaggcaacttgaacgatgaaaaccaaacgtaatcattttttgccgggtgcactggcactgtatttttcctatgcgatgctgggaatcgcatcttccattctaagtcagtataaggcgcagtttgcttcgaattggggtgcgcaacaactgagcaatggcaccgttgacgtcagcatggtcgtgtcagtgattgcggcgttcgggttaggtcgcttgattgcctatccgtttgccgggccagtgtcggatcattttggccggaaggtttctgggacgattgggatcgggttgtatgtgatcttcttcatcggcatcatcacggtcaatagtttctgggcggcttatctcatcggtattcttaatgggatggcgaattcatttttggacacctgtgtttccccgagtctcatggaaatgtttccggaatcggcgtcaattgccaatcttctgacaaaattcgctgtggtcaccgcgcagtttattttgccgttcttcattggcggcgttgcggcggctggcctgtcatttcggacgatcttcatcatctgcggcgtggcgctggctgccgatgccattgccattatcgttttcccatttcctaagcgggaaaaaccacagctgaatgcagctggcacgcctgaaaaaatgcatttttcaattgggtctgtggcggccattttaattggcttcaccagttcgaccaccttcatggtttggttgaattgcaaccaggaactaggggcggcttacggggttaaaaatccagcaacgctgcaatcgttatacgccgttggtgctgggattgcggtgttgctgacggctcgtctgatcaaagccgggttaaaagaaagcaccgttttgatcctgtatccgacgattgcggtggtcatgttagccttgtgctactttgtgcagacgccggtcattcttttcattggtagttttgtgattggttatgccgcggctggcggtgtgttgcaacttgccacctcaacaactatcagtttcttccccagtcataaaggcacggcgacttcgctggtcatgattgcttcgagtattgccaactatgcggtgttatccgccgctgccgggttgaccaaggcctttggcgatgcggcaccacggatgatcattcttttgaatattgtcatcacgattgtcggcatcggtttagcactggtcgtgaagacgcaggaaaagcacgtgctagcagtttcacaagtccattagtaaaaaggagttcggaacatgtcattaaaagatgaaattgacggtcacaccgttttagctggtttactggcgcatcctgctggccactcgatgtcgccagcaatgtacaacgcaacatttgaaaaacttgggttaaatgatgcctacctgtccttcgatgttgatgcacctgaattggcacacgccttgcaagccatgcgcagcctgcattttttgggtggtaatttgtcgatgccgaataagcaaaaggccataccgttgttggacaaactatcgccggccgcaaaattgatcggtgccgtgaataccattgtcaatgaccacggggtgctgaccggccatatcaccgatggcacaggcttcatgcaagcactgagcaacgatggcttggatattcgcggcgagcaaatgacactggcaggagctggcggtgcggggacagcgattgcgattcaagcagctttggacggtgtccgggaaatcaacatttttaatcgtcgtgatgcttcgtggcaaaatgccgaacgtaatgtgaccatcattaatgaccaaacgcaaggccatgcgacattgtttgcactcgatgatcaaccggcgttaaaggctagcatttcggattcagttatctatgttgatgcgacacccgcggggatgaagccgctagaaactgttagtaatgtgcctgatggcgattggtttacgtcagagacgatcgtgtttgatacggtctatgcaccgcgcgaaaccaagcttatgcagctcgctaaagaagccggtgtgaaccacgtgtataacggcattaacatgctgatcaatcaaggcgctgccgccttccatctgtggacaggcctacaaatgccagttgattatattcgcgagacggtgtttggtgaaccggcggcagtcgcgcactcgtaagcaagaagacgaattcaagcagtcagccacgcgcttaaaatcgtcatttcgacaaatcaaaaaagaagataatcttgtaaaaaagccctgatgccagtggcacactgacatcggggctttttgcattctgtggccatgtgccaacgttttctaagctgactgagtgggcatgcggtcacctgctaattgaataaaaagtattcgcgaatatatcaacgtcaaaggttgttattggccttacatttagttagtatataagtactgaaagggaggatactatgaaatacctcattgaattcaaacgatgttggcaccagtcgaacggtcagggtatccacctgatgtgtccgggcaaatgaccacatgtgggatttcttacccacggtcacgcgcaaagtttcttttaaggttaattagtcattatgagggaataggaggtgaaccttggaaaaatcgccactcaagatcggtattttgaacgtcatgcatgataaggctgacaccaaaactcggctacagcatgttttgacgcacactgacataccggtcgatttgcatttttactaccccatgacccattacgccggacggacggtgccggaagcggtcagttcaatcctcgatccgctggacattcatgaggtagcgacgatggatgggttcatcatcaccggttcgccgattgaaaccttggaatttgatcaagtgcattatatcgccgaagttcgaaccttgttgaaaacgttaagtcagcatgtccctaatcagctctatctttgctggggtgggatggttgcattgaattacttttttggcatcagcaagctaatcttgccgcataaactttttggcgtttatccgcaaaccattcttgagccgcacccacttttgaagggactcaaaaatgacttcaagtcgccgcatgcacgctatgccgaaatggatgtccgcggtattcatgccgatccgcggctcacgattaacgcgacaacgacgaagggcaaactcttcatggtgaccgaaccgactgatacgcaaactttcgtcttttcacacatcgaatacgatcggtggggattggattcagaatacaagcgtgaagtcgctgctcatccagagatcgactatgttcgcgctaaacattattatcatcacaaaaatgattacgatcatcccaagttcaattggaagaaaacgcaacgaacgatttttgacaattggattcaacatgtcgcggatcatcgcaatgacaatcattaggaaaatcaatcaactaatatggaggcttttaatatggtgacagcagcagataatattaccggtttgattggcaacacccctttgcttaagctaaatcgtgtcgtcccagaagatgcagcagatgtttatgtgaagcttgaattctttaatcccggcggttctgtcaaagaccgaattgccttggccatgattgaagatgccgaatacaagggcgttttgaagccaggcggcaccattgttgaaccaacatctggcaacactggcatcggcttggctttggtcgccgcggctaaaggctaccacctgatcatcacgatgccagaaacgatgagtgttgaacgtcgtgcgttaatgcggggctatggcgccgaattgattctgacaccaggggcggatggcatgccgggtgcgattaaaaaagctcaggcactcagcaaggaaaatggttacttcttgccgatgcagttccaaaatccggctaatccggatgtgcacgagcgcaccaccggtcaagaaatcatccgttcttttgatggcggcaccccagacgccttcgttgccggcgtcggcacaggtggcacgttgaccggggttggccgggcgttgcggaaaatcaacccgcaggtgcaaatttatgcacttgaagcagctgagtcaccaatgctcaaagaagggcacggcggcaagcataagatccaaggtatctccgctggcttcatcccagacgttttggataccaacctataccaagacattattgaagtcaccagcgaccaggccatcgacatggctcgtcacgttagccacgaagaaggcttcctgccaggtatctctgccggcgccaatattttcggtgccattgaaattgctaagaaacttggcaaaggtaagagtgtggtaacagtcgcgccggataatggtgaacggtacttgtcaacggacctgtttaagttcgaagattaaaggtacaattttacagctggcattgatgaaatagaacatgaaatgaaagtggctcggtatctgacaaaggtcagctatcgggccacttttatatggataaaaattatatggaccatttgataaactaattaaatgcaagtatgcatcaactgatgatcatgggcatcagtccgtgattctttctttactttagtcatgatgatcaagacgggttcctttgaaaatgacggcttgaatttttggctctttctgcaacagtcgccatgtatagaccagactagctgtggctgacatgatcatgatgttccatgtgcttgaggaaaagttcttccatacgaaaagatctttttcaatctcctcactaagttccgataaaacatccacatgccatcctgatagcaacgcaaacccaagaccataaataaagatcacgatccagcctaccaaatattgccatccgtggcgaatttcaatgataggaaggccattgacatcaggtttttgagaaacgtggatttttagaccagttgtttgaaaccagcccagaatggcaccaatcaagatggttaccgcaagtgccaaaaaggtaggccgcttgtgagaaactaataatataccggtcactaaggtataagcgggtatgataactaatgttaaccgtgagattctttcgaaacgaaagacatgacgagtgaagaaaaacaatgcagcaatgagtagtattatttgtgacatagggggcctcttattcaggattataaaggtagaacttaattttcaaagtttactgctttgaagatttcgaagcaataggacgatgcaaattattcgagaatggctataatgggagttataagtctccatggtgcaacggatagcataatggtcctcgaaaccacagatccgggttcgaatcccggtggaggcattatttagctttctttaggttattttagctttttaaaaagcttatgtatcagcatttacagcaatttaggtatctttagagttactttgtttttatttttcgggggacaaaaaggggacaaacacaatcatagctgatccatgaataacacggccttatgtgcttcttgttttctctgtgagtctaacaaatgaccatagactttcatcgtaatagtcacgtctgaatgacccaaccgctttgaaatataatagatgtcgacgcctttgctgatcaagtagctgacgtggctatgacgcaacccgtgaaaggtgatctgcttatcttcagggatcccagctttgttctgaatgacgtgcagggctttgttacatgcgctgtctgtaatcacgttgtgacgtggatcacgcataatcatctggtcttcgtcacgatatccagtacgaagataagatgctgcttgttcctgatggatcttattaagaagctcaatgacgctgggcgatatctcaatgtcgcgaactgacgaatcagttttagttggtttgaatcctgttccatacaaatgatcccaagaacgcgtaacgtgaatgacgcagagcttagtatcgatgtcaggccaagttaaagccaacacttcagatattcgcatgccagtcatcgagccaatataaacagcaagcgccccgatattgcggtacgaagcccgttcaatagcaattgctttaaccttagcgaaatcacggctgtctagcacctttactttcccactagagcgcacgcctgatgtcttcgttccaaaggtaaaatcagaaaatagaatgcgttcattgattgccgcttttaccatcccacgaacatagctgttcatcttggtaacgatatctttcgaacgctcacgtggccgctttcgtgtggttttctccttgcgatctttgccagcagcaaaatcgttaataaatttctgccattcgataggtcgaatagaattaagctttcggccatcaaatcggctctttaggtgctttctgaaaagtttgtaacggtatacagtgttgattgacttgccattgattcggtatgcttcagcccattgatcccaataatcaagtaacagaacgtcttgttttgatggatcgccaccacgtttgaggtcatcttctacagcttccgcagcatcttgcgcagatgatttaagccgatacccgccgtgtgaagcaaccagctgtttaccggcggagtccgtatacttaacccggtattcccaatatttgccgcgtttcctaaatgttgccatgcgaattgcctccttttctggtaaaatcgagtatacaaagagccttatgactccgagtatttgttaggcgtctacccgttcactttggtcggtggggtaggcgctttttgcgctatttcctgcctgcttttttcttgttaagtgcctcgtttacgttactgagcgaaatatctttgatgaatcgtttttctctaattctagaaaaggggacaacgatcttgtcgtttagttctgttttttctttatcagtgaagacttcggtgtctgaaatgtctaggagaactgagtgctcatattttttgatcggttctccttcaaaatttttccaagttttttcgccaaacttataagagattactgtaattggtttcataggctttacccctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccgttcattcgggtgataggcgtggcaaaagtaaaccggtatccgatagcgctttgtaagcgcctgatcgcaggaaaactctttaccgtgatcaaccgtcactgatcgaaccggacccggaaagtccaccatcagtcttgcaaatcccttaagaacagcattttgtgataagttttcaagcttagttgtcgccattaaacgtgtcacccgatcgacaatggtcaaaacagcagcctttgacccgcgaccaccgcgaactgtatccatctctaaatgtcctttttcggttcgccgattagctgactcactgcgaatctcaattgaggtgcctactgcttggttatagcgcgaccgaaggtcttgtcttcttttatgacgtttaccgtgatcaaagagttggcttggctgaaaatcgacttgtctttgataaatccagtggtaaatcgtgtgtggcgcacagtgaacggcataaccgaccatttcaggggaccaacctaggtttagcttctcagttaccatccgcttcaacttaggcgttaaaatcgagtgccgaccacaacgatgccgacaagtatcggcatgatcctgagctataatggcgcagtaatcaccttcagggcaacggtgaagctcatgcctaatagaaatacgagagcggcctaaggtcgcggcgatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggaccccctacaatctgtgtggctttttgtgatataattaagtgaatgaaattcatgcaaaaagaaattaggttagtataaatcatggaaatgcaacaactaatcttagcgggtatccctgggttcttgactttcatatggctcgataagctagatgctattcatttcgatttgccagcaagacaggcagatcgtactatcgctttgattctgatatctatgctgaatgctgctggtggcctcgcaatttaccagcaaatctggggaacagttggtcacagcttctggagtgaatttggccttttcgtagttacgctgattttgtctgttccattagccttcacttactatttcttaattaagctaggaaattcatgcctgatatggatacaagaacaatttcacgttgccaccgtattgccagggtcgccgctagttgaggcattaaaaaataaagaatacagtgaggaaaagcttgtcatcattttcgactttaacgacaagcttatctctagtggttacgccaatcgcctacctggaagcgacgacccaactcaacaaatcgggttgatgacatatggacaggattggaccgtgaaattggcacagaaaaaatatgatgagtctccacaaaacagtgaacaaatcattgacttcgaccgacaattgaaaatttatattatcggaatcaatccttattcttagaagatgccgaatccggcatctttggtttggggggaacagggtctttgtgaactaatttgattgaacgattttgtacatttctgtcaaaaaagaggccggattttttatctggcaaacttttagctttatctgagttgtctttttgcaatttcttttcctccacataatctcattgctcctcgaccacagcggccggggtttttttgtatccagccaacactcagttaaactgctcgacattttgatcatcgtcttgatcactagcgcaagcggttgttgcgccagccaacaaaacaatgagtaagatggcaactatcttttttagcatgatgactcacatcctttacttggtatgtggcacaagccccactctccggcttgcacggagacgccgcttgcgttggggaagggactaaataagaccgaacggtataattattataataattggtattgtgcatcctaaagtcattgcacaaccgaagtcgctaaaaaatttcccggttttgtcaactgattgtaaaaacttatcagcaccattggcaactttttcccatgaattgattggcatacagttctgatgttcacctggataaattattttagccccgcagttggggcaaaagcgctcgcctttaagctgatgtttacaattcaggcaataaggctttctttttgctgcgtacatttttttgccgacttcagaccattcttcaccggaattattgttgagcgtcttagctggttgctgatcttcggcgataagttttaaagttactgggtctctataagttttgacagtaatagaaccatcgcttcgtgtacttgtttgtttatatgtcccccgtgtatagatacccacagttccactttgtcatttagatacaaggctgagaatgttttgactttgtcgttcggtatctttccaatgaagtacttagtttgcctaatttcggcatatactttcccatcaatatcgactgaaactggttgatttaaggcagcaaacttacttagttgccatatcttattttcaaaagcagtatcaataatttcggagttgccgagaccatcatatgcttgccctgcatcaacctggtcttccggtaatagattcattcattcagaaatctgagagtcttgagtatctaataatgtgcatatttttgtcataatccaacatcaacatctttctacaattaattaatgacttttccgattatactgatatcatctgcttttaccagttggttgcaagctaattcaacaatgaacagtcagtagttttcataaaaccgttcaatgcattgaacggcagaatcctctaaccattgcggtatcgctaaatcattcatgaattggtcaatgtttgctgattcttctggaatgtctgcgaaatacattggaacgataattgatagcgcacgttggttggctccattctctgtacggcttttagtgtattgatttgtgtatcgaagcttaccgttatccccgttgagaatatgtgcacattcatgagctgcttgaaatggcaactcatttgcattcggccatttgttgttaagaataattaggcgagcttctgtatcaaccaaagggccttggtcctcgtgtaaggggatagtcgagcagcctatattgtgatcccaagcatagtcaatcacctgattcaacaagtcctctatatgatcattcatgacgatcacgctttttgctgctattattgcgtcgttccaaaatagcttgaatgatttcccaatcgtcttggcgaacaggctgtccttgataggtaaagatgtttgttcctgacagatcaacaggtttagaaccttcattgtcaggattggggttatccgtattgccaagtaaataatccacagaaacttgaagaacatcagcaactttctgaacattctcggtagatggggtcatctttttccatcgatagatgctgttaatgcctatacctgctttcagagctaatttttggagtgaccaccctcgatttgaagctagtgtttttattctgtcgtaagtactcatgagacgagttctcccggtcatgacgaattatttatcacaagtggtttacaatttatcacgtgtggtttactatgaattcatcaagtaattaagcaaacatcaacaagctaatccatccatgtctttggcgataacggtggataagtagatcatctgtcttatttgctatgccattaatttaccactcgtgataaattaatgcaacaacttgattgattctttaaatgtaagggaggtgagtacatggtaaacgttcagctcaattggactgctaatcgtaatgactggaaaggctacttattacatttgaatttgtcacagctcgacattgcgaaatttctcggtatcagtgatcaggtaatggcaattctggttaaaaagatgactgacggtcagggattaactgctaatcagatcgacaaagaccgttggaagcgagctattgaatacgtcaaatataagcagtcacagcaaaagaagatgacggtatgaacgggctaatcaaacttcatgtggaatagggaggaagataaatgatcaagccgattgatgcaattcgcaatgagcttccagtggttacgtccaaaacgttagatctatttgagtctgctgttagtcaagaactacaaaaaagaaacccaaaagccacattccaagttagcatccttgggatggcggtattgggccttctggtggcaacaaggctagaggaagtctctgacattaacaactgaatcaagcattgtctgtgctgcggacatgataacaaacgcttggacagcatcatcgacactggagggatcgtaaatcttaggggtgtgggctttgggatttcgataaagaaatattacggttctaagaaggttacgtaatccggaatatatgtctctgtcggtttccgttgcaagcatgttgcccttaataacgagtattggttgcttgtccgaaaacacggtgcttaccaaactattgccatctttttgtatgcctgaaagttgctgaattcgattaacgacacccttgcttgcttcgaagatggcgtgaaagtagtcgccttgaagaaattgttcgttgcagaatttcatcactagagggtgaacattgagttctgtaagtcgagcgctaagagtttttaagcgtagctgggcttcagaaaacgtagtcgcggtttttgctgatgcgattcttccactgtcatccaaacaataaccataaaaaataaggcattcatttatctcatatcgtaggcggccccattcttctggctttgaaataaagtcttgaggtcgagcaatgtactggatggctctaaaaaaggggcgactattgtgtgaagcattacactcgtgcctaattatttcgtctaaacgacgccatttggtagacgctttgaaccattgattgtcagtttgtctttgaagatcataatcgaaaaatccaagcaaagaaaacattttggtgattttgggcccagtcgtatattctcccaagattttagatatattttcaacagctacggcatcaattggtttggacattacattccctccttatgaactattatcccactgacggagggcagcaaactatgaaaattcatgaaagaaggaaacgcattgaatgaaccacaaccaattgaacaaaacggccagcgtgtactgaccaccgaacaacttgcagaattgtacggaacgactgttggagtcgttcaaatgaactttaaacgaaactcgaataagttcattgaaggaaagcacttcttcaagctggaaggggagcaacttcgggcattcaagaacgaaccgacaaattgtgggttcgttgggaaaaatgcaagtgctctatatctctggactcgccgcggcgccgcacgtcactcaaaaatgcttggtacagatcaggcttgggatatgttcgacagtctggaggagaactactttaatccgaaaacacggcttccacagacgccagaagaaaagcttgctttaaccatggaagttgctactcgaactgtaaaacggattgaaaagcttgatggtcgtgtaactgatctggaagagaaggctttgctggcaccaggtgaatataactacatcagcaaacaagtcaatcgagctgttgcaaattatctggacgtacatcactgcaaacttaacgcaaaacagcgcagcctcttttatcgcgatattaaccacggactaaatgactacatcggaatcaagacacgtacacagttacgtaagaaagacttcgataaggctgatgactttatccagaattggacgccatcaacagcaactctcatgaaagcacgcgagatttcattattggaggaccaacaacaggaggctatctaaatgaatgaacgcccaaaggaaaagttaaccaatgtcgttaaagtacaggacaaagatgttgaagaccaagtaactggaatggtcattgatcttctcaaacaaaaaggcttcacatttgccaactttgaatcagttgtagcacgtgtgaagtctcactatcagaacaacgcaactatttagaccaggtgtaacggtattgttcgcctgacccattttcggcaatcagataccaacggccagctccagaaacccgaattgtaactggggactcatcatagtgacctccgaaatatgtaaagtggtcaccacgttggtgagcgttgaagtttgcgtgatccaccaagtaaacgttcgcagcgtgcggaagttcgactgtaacagctagagctccgcccggattgtcataataagggacttgcaccatgaagattcacctcctttcggtttcattatccgtcaggaggcgatcacaggaaaggagaaaatgccatgccgttgttgcaggttgttgaagatgatcagatttcaagcaaaaagtatttagcggttgaagaagaagaactggcaaagatgattgaggagaaccaagagttaaaacgcaagctagcagcacgaggcatgtggacgctcaccaccgcaacaagctatgtcgaaggacataacaacacgtgggtagttaacaatatcttgaacgtcccacgcttccacaagttcttgcaagataccgtggtttcatatccaccgcctggcaaaaaggggtatctgtttcatccgaaaccatggctcgacttcttagacaaatggttctcagagatttcaaggtcgcttagagagaagggtaaataatgattggttatttactaattgctggtggcttcggcgtgatcgttggccactgcttaggccacagcggaaattggaggaagtggattgaatagcccggagaccaaattgaacaaaaaatattctccaatatttggcgatggtattagtgtttcggccaatgatgttcaaatggcagttgatggtattgtcgcgactttgagtaggcatacgagcaatcttgcggaagcaaaagcaattttagacttgatagatcttgatcaatacgctgaattaaaactgattaaatagtctttccgcgctcgttatgtaaatggatttcgctacttcatctgtttttgttggtaccggcgtgatgtggtcgaaggacgtggccacatcagcgttaagcaaaaagtcttttgtttcttttttaccaaactcatctgaataagttatggacaaagaaaactttctggtttttaactcaatttctgagtttttgactgaaataacggctgcataggtctggtcgggtgctatcagctgattagaaaataattcaaaagggttgttttcaaactttagttgcccactgtcaatagccggatcagccttgactgataagattgttgctcctgttcggccaaagttcttgatcattaggtaaattattgtagtttgcgaagatctgacaactttaagaaaagaaacgatgtacggcttgtttgcatcacgttctgatttagaacttcgtattaaagcgattgttgatagaacaacagccactatcgaagtcagagcttgtacgacgctggaaaagagttcgtatttattcattctaatcacctcttcgtgattatcgcacaaaagggagcaaacaatatgctctattcacagcttaatcaacgaaataattggcaaaacaaaaaccgctaagcgctagcacacttaacggccaaaaatgaggtttcacattgattgacctcattatatcacagaaagaaatgaggtaaaacaatggccagagaaattggcaagcaacttgaccgtcttgaatcacttgcatacaaagtaagaactgatcagtaccttttggattatttgagagaatgggcagaaaccaagtgcgatctattcagggatgatgatcctcacatgaccgatggtgagaagattcaagaccggctgttcctaaaagacaactttaaaaaatacatggatatcttgggtcaaacatcactcgatatgatcaaattcgaagcagacttaatggatgttcgccaaaacattgccgatcaatgctttcatgaaggcggtgtcgatcatgaatgagaagcctggttactatgcaatcatcccagcaggtgtgcgctatgacaaacagctgccacaaggagccaagctcttgtatggcgagatcacggcactcaccaataagaacggttactgctgggcatcgaatgactattttgcaaagctctattcggttagcatcggcactatcaaaagttggctaaagtgtctcgaagacaattcatatatccgcagagtcatcaaatataaaagtggaagtaaggaggttgaacaaagatttattagtttagcccctcggtcagaaaacttacccccctcggtcagaaaattgacccacccccggtcagaaaactgtccagagaataatacaagtattaataatacaacaacattaggggaaccggagctcattaatttttgggagaaaaacggttttggttttatcagcccaaagaaccgtgaagacctcatgtactgggtagatgatttcaagaagattggctcaactgacgagcaggcagttcaggtagtcaaacaggccatgagcaacgcaattgacaataacgtgcgtcgttatagctatgtcaatgccattttaaaaaattgggaatccttaaggcttactagtttagaggcagtgacggccgatgaagcccaacgaacacaacgccaaaagtcaaaatcaacgtcacggcaagcatctacagacgtttatcaaaaccaaggggatgtccaagatgaagacttaccttggtagagaagaggcgtgtgatgagcaatcttgaaactaatcaaggacgtttagcagcgatcgaaacatttgctgaacgttgtcccgattgtggcagcctcttgtatcgcccgaagggattgagcaaagtaaccggtaaaaaaatggccggagtgtgcatgaattgtggctataaacagccacccacggagcctaaaaacgtcacgccagatatggaaaaagaggcccgcaagaaccgcaccgttggatactacctagcttattcggtatttagtacagacgcgattattgcaaaggatttcaacaacttccatacagatggcagccttggacagcagcagttgaaactcttcgctgtcggtttgtctaacaaaatatgccgtaacgaggttgtacacgcattgattatcggtgacacaggagttggcaagtcacatattgctaacggcatattaattgatactcaggccaagaccggttatcgcaaaacatgcctttttattgactggaacgctttaatgcagagactcaagtctggcatgagtgctaatgcacaagatgtgcgaatgaagaacgagaaaattatgcatgagattggcaaggctgatgtggttgtgatcgatgatctaggctccgagcgtggtagtgattttgaccgccagacggctgatgatgttttcagaatgcgggaagacaaagcaactatcgtgacaaccaatttgcacggacaagatctgaataagaggtacggcgagcgaactatgtcccgtatggccaagcacggccaaggaaatagctttggcgttaaaggaatcctagatcagcgaaaagaggcgttgccttgatgaaagaatacgtgattatggacacggagtttaactcaaccagtaatcgagcaattcaaatatcagcagtcagaattcgagacggtctgcacattgcagatcagttcaaccgattcattccatcaccagataaatttgatcagcttcacatcattaggacaagtaacatgcgatacagcgactatttagctttaccaagcctgcagcaaacagtgcgtgactacgtggcctggatgagaactacgattgacattgtgggctggtcgattgaaggcgatgcgggccgcatcagagaaacatttaaaaaggggtcacatggcatccccaagaactggaagtttatcgacatcgcagacatcgttgaaaagcggtatagctttaatgctacgcctccgctgcaaggactggcgaatgttctaggcataccagtaaaccgtactcacaacgcgctagatgactgtttaaggacatttggagttatcaaggcattggagtcacgagacggaaagctattttgaggagaacaagcttgaatttagcaaagaaaaagtaggaggaaatactatggataaattaaatttgaatctgaacgaactggctgatggggccattaaagaaaagttgacaaaggcattggcccaggttgccaataacattcttgatcctaatactgatcagagcaaagcacgaaaagttaccattgcgcttaactttaagcctgacgatagcggagtcgttaagcttacaaccgatgtcaaaacaacgctagtaccagacatcagtgtcaccaccaatgtattgcttggacgtggcgaggacggatatatggaaatgaacgagttaaagtcaggtacacgagggcaggaatacttcgacccagatgatagtacgctaaaagacgacaaaggtatcccaattaaagacgataaggtaacagacgcaccgattgatttccgaaaaatcaagaacgccaaggaggccaactaatatgacaacagaagcagatgcacttaaattcacagcagaacaggcagttactgcaaatggtaaacgaattatcgaaacaaaaaatcgtcaatttttgattaatggtaacggtgatataagggaatttagaccaaatgatggagcaaacgaagcgttacaagttcacacattgactgcagttgtcgattatatcgggaaggtcagcgaacgttctgccagtcccttaattgtgcaagtagtcgatgagaacagcgtattcgtattaggagagctcgatgattttggcaaccgggaagtcttgatcaaggccaaggcaatgcatccctgctacccatacggtcaatggctggattcggaatcattcatcatcgcactgcaggcacaattcatgaccactgaggatggcaaagtgttgcttaaatttgttggtaatcttaaagacgaatctgcacagacgatggttgatgacggtgtaagccaagttgcaaccgcacgcagtggtgtggcatccgttggcaaggtagttgtcccgaatccaatctcactacggccatatcgtacatttctggaagttgagcaacaggaaagtgattttgtctttcggatgcatgaaggtccaaaattggcgctctttagtgctgacggtgatgcgtggcggaacacagcaattgatcttgttgccgaataccttagtgagaagcttgtaaaatttagcaagcacgtgacagtacttgcgtaaggagacataacatggctaataaagtggaaagggagtcgaattcgacccccttaaccaagaaacagaaaagctgtcagtattgccaagagccgcataaacctattgaagcagaagatggtagttttctgcgaataggtatgtctggtgggaactgttgggacggagttcatcctgaaaaaataaatggtgcggcaatacacacctgcaccgcagtcggatttgataatgctgaggttgatgaaccgattgcaatcaattattgtccgatgtgcggacgtaggctggaagcaaagcaatgattgccgtcatcttgctcatcgcagttgcttcaatatgggcgtgggctaactgggaaagaggaaaatgaaatgaattcgttattaataaagctacttatttgcgcggttattactgtagtcatatgtgcatacttcttttggctgctttttgatcattttgttagcaataggcgcagcaagacggttcaaattggcagcacggtcttcatcgtcagaattggcaaaaagcaatatgtatcttacttcagcaaatgtagcaaggaatttaagacatcaagcgaaattgattcatctaaactatttgtgctaaggcatgacgctgaagctgctgcagaagtttctggcgggattgtattaaccttgccaatcaacattgacgatccaaacgaacttaaatattagcaggaataatcctgattcaatgtaaataaaaagcgcgcctgatgagggacgcgctggaggccagacgtacgattgagagtaaatgaaatcaaagattaggagttggcctccaatgacagtatagcaaacgcacatgttgaaagtacatttaaaagcatcaaaaaagcgcgccgggtgttgacgcgctctggaggccaaacgtacacgtgattgatagcaaatggaatcatttaaaaggagttggcctccgtatgcagtataccaaaaagcgcgtcacataagcaacgcgcgggaggtgcttgaatcagattgttcccccaacttataaggttaacacgcataagaaagcatctccaaaggtagtatagcaaaagtcgccctggattaacaggacgactcagtctaacaaatcgaattatttgaacagcaggtatatcacaaaaaacaaaagcgcaccacgaaggcacgcttatcctacaaacccaaccaaatcataccataaggagtggatgcagtggtgcgagcaacgagatattttagcccaattgatcatgataaaacaattgaaaacgccaaagaggtcttggggaactactggcatcacaagcggctcgctcaacgcaccaaaatagcgctcagaagtcccgtgatggacggcatgcctaagtcacctagctatggaaataaagccgaggacaagctcgtatcgcacgctgacgagctgtactatatagcgtgctgtgaaggcgctattgaatctatagagaatgaagactaccggatcattttagttgagagctatctgactccaaagacgacacgtaaatccagccttcagttagccgctcacttgcatgttgaccgaacgaccctttggcgacaaacacaagaagctctctatgcttttgctgaaatatgtccgctagtgaaactagatgcaacatccgtgcaacaatgatgcaacaaaaaacacgcttttctgccttattatgttattgtgccaaaggtgagaaacctgagacaccgcttttttcctccgagcctcagtgatgataaagctgtggcaaggcgtggcaaatggactggctgagatagtcaggcgggttcgattcccgcatgccacattgccaaactaaggcgtaaaatctgaactttggcaacccgacctgataaagaagtgccgcttaaaatatcaggaggtgcgttaaaagactaatgctaggatacccaaatgtgtgatatggcatttgtcgtctatgtctagcggcttggcatagaacgaggccgaagaaacgagatgttgtgggaccaaatcccaccggcctcattgtccagtttagcgaccggacacagcttgcgatgaccccatctgacactgtgagagcgagcagcagacatatgaagcacagatatcacctcaatgtagtattccagttcacgctggggtactattttttgaggtgattagaaatgagctttatttctggatttttgactaaagacttttgctcaattgtggcagatagaagaatgtctcaaggagcaaaaacggttggggaaaactataaaaaatttatgttagccgaatcaaacattttgattgcaactacaggaaacgctcaagttgctgacataataaaggacttcataaagcgattacatgttcaaagcaacggagctcagttaaactggcaactttacgtaaatgtgatccaacagtttgttaaggaaacgttaaaggaggcaaaagacatagatggaaattgtgtaaatcaaattgttgttatttgcggagttaatggtaacaaaatcatggctttggcatttggacaaactgacgcaggttatattcaacgtgagtacttgcctgaggaaaatgagcaaaagttctttactatgactcctccaggtgtgaatccagatgccgtcactaaggagttcatctcgattaccaacaaaatcgagattagaacatatagtgacatagttatagttcaaagcaaattgcaagattatgtggcagaaatcgattcgggaaaatcagttaatacacataagatggggatgggggcgaggatagacggaatcaacggaagatttaaagaatggtcctctggtaattaaactacccgagtttttagactcggccggggatcaatgcccagagatttcgggtgggaaagttgatattatttggctttgacgcttcggcgtctttttatttacacgagcactccgccaaacggtgaggtgctatttttatgcgacggatttacaattcaagtgcaacaaactagtcaaatagaaaagactcatagcctgagtccttgtaaaatggaatcaccataagaccaactacaaggagaactcgactatgagtccgtacacccatcttaccttaaaagaccgtgaatcgatactgcttggtatctctacaggcaaaactcttgataccatcgccaaagagataggtcgttccaagagtacagtcagccgtgaaattgcacgtaacggcggctggcggagctattcggcagccaccgctcaggaccgctaccggcgggttcgcttggctagcaggcgtcctcggatcctcgatcgaccggggactcgtgacgctgtcattcgatatatcacggtgctacattggtcgcctgagcagattgccggtcgcttgtcactagaaggcagtcctattcgcatcagctattcgactatctacagatgtatctacctagataatctcggcgttccattgaagagccatggtgctcgcgggctaccaaggctgcttcgacaccgaggcaagacgcgcaaaatcaaaggcaccataaatgaacgccgggggcgcttcaatgacgtgccatcaattcacgaccgaccccggtcggcagaaaatcgcagctggtttggtcactgggaaggcgatacagtacgcggtaaaacaggacactctgcattagtaacattagttgaccgtaaatcacgctatctgctttcgaagcgaacggccaacgcaaaagctgacactgttagagacgtcatgattgagctgcttggtgccttaccagctaaccgagtaagaacagtgactcctgaccgtggaagggagtttgcccggtacagggagctggcagaacgcctgaatacaaaggtcttctttcctgacccacacgcgcctcaacaacgaggaactaacgaaaacaccaggactgattagagaatactttcccaagaacacagacctagaccttcagagcgaccaggaaattgagacttacattgaacaactgaataatcgaccacgcaaggtcttaggctggaagacgccatcagaagtcttcatgggtaaaaagttgcacttgagttgacaattcgtcgcaacaaaaaacctccagctacccaggctgaaggcatgcatgagggaagtaaatgtgattgcaagggtggcttgccttgcacgatcagtatagcagatgagtttatcaaatacgtaaagctctggtaccggatttgtacaggtttaaaaaagcaacaaaaaagccgacactttgccggccagttaattagtcttttttatctgtgctgagcttgcttttcacatcatctactgtgtctttaacagcatctttggcatcatcaagcttttccttggctttaccaagtatgccttctgctttgccctgtgtttcgcgagctttatcacctgttactttgccttcaacttcttttgctttaccggagatcttgtccttggtgctgtcgactttaccatctaaactcatagatattacctccttttaacatcaattatcatataagcttatacaaagtgcaacaaaaaagccctcagagaccagtccaagggccaaaaggatgaaaaaacgaaacgtatgtgtgaatagtagcaattgacttggaggagaacggctactgctcacgactacataatagcacattccttgtataagtatactaaaaaagccctcggttgggggccgagagctagaagattagggtagtaccgaggagtgaaaatgagtatttatctggaacaatttaattttagcttattgaaatcttttaagcaacaaaaaagctctcggggccgaatccgagagccacaggaacaacggaagttctttatcagaaagtagagcagcgtcatcaaactgctcacggccattatatttcgggaggcgagtagatgcaatggacagatgaacagatcggtgacattaggaagctcgcctctgaaggctttacaagacgcgagacagccgacaaacttggaattagctatgatgcgcttcagggaaaagcaagacggcttgggatcgagttccagaagccactgaaaaatgaatacgattcagacggcacaaatagggagacaccgtccgctgacagaaaagtcgctcttaatgctgatggtagtcaaacagtcacggccttaatgagactcaagcatgagccaaataaagacccacgaactttgatggagttgtgtggatacgatcctgataagttcgagatggtcttaggcgactacaaagtgtatgagcagcatagtaccgaagacggcacagttccgcagtatagcattcatattcgcgtaaagccgaaacaaggcttatcgataaatgaaatggctgaagcgttcaacgacaaaatcattccggtcaattacggcatgaagaaatcgggcgatcgcaacttagtcatcccattgcctgacctgcattttggctggacaacattcgccgatctaaaagacatggtgagtcaacttagagagataatcatggacggctacaacgagattgtgatcgagcaattgggagatctattccatagtgatcagattcatgtaacacaaacggttagaggaacgcaactagatcacgcaaacatgcgtcaggcattccatgatgctgtgaagttgtttgatcagattattccgctggcaattgaatatagcaatcacgtctcaatcaagagcgtgttcggtaaccattcaggtgatctcgaatacgcttttctttatgcactgatagatcgctatccacaagtacacgttgatctcaatgacagcaatttggcaaccgactggcgctgtgcatacttgctagggcatgttggcattatgctcgcacacggagatgtagccaagaacaactgacaggactttttccatttgagtacaaaaagatattcaatatggcaaaaacatacgaacttcactcaggccactatcatagcgagcggtttaaagatgatcgtggcattatgtggcgccagcttggaacagcaaagccaaatgatccctatgagattaagaatggcttcaccacgggcaaacatctgctgtatgcgttcgtttatgacgacacgcgattgaggtgtacttatgaactcaactaatgcgatgaagcgagtcgggtacggatatgtaagccacacagagcaagcaatcattgagaaactatcgagagaagagaaacacatgcaagcaatcatctacacaaagccacactgccaaaagtgtcggcgaacagtattcaagctgtcacgagtcatgccagtgcaaaccatcacagcagacgcggacgactacgagcggttccgcaagctaggctatcgttcaatgccagtcgtaacaatctacgaagcagacggcacacacgatgaatggtgcgatttaagggttgataagatcaagcagtacacggagggaaacatatgaacggaaaattaatttacttggttgataaggatgagtatatattcataacaactattaattggcaagaatgtcaatggtccggacaaaaattgtccggttctgccgaatgcgtatggtggctcctatgctgtaattacggacaaaaatagtttgtgcgataattgacagatgaggaatattttatgaccaatacagctattcgctacacccccgaatttaagcaaaccttgattgatcttcatgaaaaaggacactcattcaaagaactacatgaagaatacggtccttccttagacactattcgcaaatgggttcaggcggccactgtcattgccattgatcatcaaggtactgctgtgaccaacgaacagttcaagcaacttcaaaaagaaaatcgccgtttgagggaagaactcgatattttaaaacgagcggcggtgttgctggcaaagcgttggatatactccttcttgggtagacaagcaaataattaaagcttgtcttcctagggaggagtttttgtatgggccgaaagggttccagatacacgctggaggagaaattattctatattggtctggttcgtgagggtggctgggcaccttgggctgtccagcgagaatatggtgttaggcataatcaggttcgacaatggcttgaacgctttgaagcaaccggtgtagacggcctcaaacccagaagcgttcatcagaagtatgctgaggagttcaaattagagattgttcagaaatatcttgcggggcatacatcgtacccagtactagcccgagaatatggtatccccgacaatagcgttattgttcggtgggtttccctgtatactagtggtcaaccattacaaaccactgggagggccagaccaatgaaggacggacgcaaaaccacacagattgaacgtatcgagattgcacaatggaccattgccaatgactacaactacggcgcagcgatgcagcaattcaagatctcctacgggcaggtatacgcctgggtcaagaagttcaagcaaggcggcgaatctgccttggaagatcggcgtggcaaggccaagaaagacaatgggcaactgactgagatcgagcgtctgaagctcgaaaataagcgactacaagcgcgactggtccatgtgtcaacggaggcggcagtactaaaaaaactccaggaattggaaagaaggaatgccggtcagacgaacaatatcagaccattcaacaacttgcacaagaagtgaacccagacgcaggcaagctctacggtattagcaaggcttgccggatgatgggcgtctcaagagcagcctactacaagtggacacatcgtaaagtgaccgtccatgagcaggagaatcaggccatccgggactacatcattgagctcgaagagaagaatcactacgtcttcggcgttaaacggctcatgacgtacatcaacgcggagacgcaataccacgtgagtcacggccgagttcgccgaatcatgcggttggcaggtatccgcgcctccattcgtgtggcaaagcgtgaccgtcaagtggagaagaaggcgtttctcctcgtcaataagctctacaccgtcaacatggggcacgccttccacccagtcgctcctaacgtagtctgggtgaccgactgctcagagatcacctacggcaaggacaacaaacagaggctacggctaagcgccgtaaaggatcttcatgaccacagcgtgattgcttggtgcgtagcaccgacagagacggctgatttggctactaaaacaatgaaactggccatcgagaataacgatggtatcaagcctgataccgtacacagtgatcagggcacggcttatacaagtagcacctataacacgttcctggcgggcgaaggtatcacgcacagcatgtcacgacccgggacaccaggtgataacagcccgatggagagcttgtggagtcacctcaagatcgagagattttcctttgagcactgcttatcggaactagaaatgatgaagcgtattgaggcggcaatcaactggtataacaacgaacgccgccaagaaacactaaacggcatgaccccgatgacataccggaatcatgccgtaaagaaaactgcataggcactttaattattttacctgtctacttgacgcggaccagcgccgttgattcatagcggccgaaaggccgctctttttatgattcaagatcaattgagccgggggcaccgcatcacagttattctccgagcgttacggatcccttcgagtacctactatgactggttaaagtggcatcctaagtcacgaaatcgccgccgaattaagcttaaagagctggttcaggttctttggcaacgtcgaaaattttacggatacgtgcggattgctaaacgcattcgtaaattacttaaatgccgcttaagtgaccgcacgatttggaaagtcatgcgtgaattggggattcaatcgacaatgtatcgtaaacgctctaaaaagcctaccacaaccactgacatgtcacaaaaacctaatttaatgcgacacctagctgacttgtctgaggtcgtgaccaccgatatcacctatattcaactgatcaaccaaaaatgggtttaccttgcaacagcgtatgatccaaaagcgagaaaagtcttagcttggcaagtgggtcaacagatgacacaagacctcgcggtcgcaccgattcaagcgttaattcaccaaggttatacttttaagatggtgcatagcgatatgggtagtcaatataccagtcgtttatttgagacaacattgacagatgcgcacctgcgtcactcatattcgcgcaaaggcaaaccggctgataacgggcggatcgaagcctaccattcgctattgaaacgagaatgggtccggctggatcagatcaactatgaatcaattctagacgtcactgaatccattgctcgttacaacaccttctacaatcatgatcgcgagaccaacggtcgcggtgcttgcaaaagaaagtcagcagctgcataagtaacctttcaataggcgcacagccctggggaaagaccagatgccagggcttgtttgtagtgtctcttgcacgttaaacaagattaaacgctgataaaagatctgataatgcgtgaatttaagtgacaaccatacgcattcggcagaaccggacaatttttgtccggaccattgacattcttgccctttgtcaggttactaaggaacgaccctcaacattggtgcgtcggttgattgctactgagaaaagactttatgattgaggctttttaccgtcctacaattcaaaaattgaaaagtgaggagagattaaggtgttgtggctgattctcaaatgcagtttctggatattactaggctttatctttttgtgtgagcttacaactattcggattagcggattgtgttctcgtgaagaggaacgacaggaagctcttgaaaaacatcgtcaacaagcaaaaagcgcgccctagggcgcgtttttattaggtattaacgtacctccattttaccaaagttgtgctctgctacgcaatttaatggtgtgtcacgggacaacaaatgccgctactgggaatcgtggttcgattccacgaggcggccttggctaatgccaaaataatgaacgccaaatgccagctaattgcaggtgttttttgcgttaaagaaaggagactgaacatggctgaacctgtaggtatttggttacatgatcgcaatttgaagttgatttcgaaagatcatgatgctctttcttatcgagtccgagcttcatgggttaaggatcatgctgattatccaattaagcctggtatgacggtggtgattggcaatattaagccgcctaaccagctgaaaaatgttttggttctaaaggtggtgtcagctgaattaaaaaaagacggcagtctagtgattagcggagaacgcattaagtccgtcccaaaaaacttgatataagaggtgatcatatgttcaatttggttcttcaaacaaaagacatcaaggaagctaagcggcacaatggtcttcttgaaatcagattcccacccccaaaggagaaggcattgatgttgaagttgcgtcatgcggtgctaagcatcgagactggttggcctattctgccagatacaacttgtattggtgagatcgtgcgggtgttaccaagcaaagagcgcgtgatcgtggcttatgttcgccctcagaacgagtttaagcgatttgttgaagcatattaatgcggaaaaaggaggattcattcatggcaaacaacaaaaagaaaacagcagcaatcttgctgataagtgcgattgtcttgggaggcggcggctatacggcttatcagttaaacgctgcccccgcttcgcaatcagtcaagaaaagtagcactccatctaagcaatggcggacgccgtcaaaaaaggtcgagcaaaaacagaagaacacaaaaccttcctctaacaaacccgatcagaccataaaagatgccctggctccggatctgccgaatagcgataaaagtgatcaaacagtagtcgcctttcctttcagtaaaaatgatttgagcaaacagcttgagtcgagtaatagtcaaagccttatttcgttggcagatcaggcaacagcggaacagaacacgccaaaagcggcagacaatacaggaacaacgcctgaacctaaaccgttaacagataaacagacgactgataccaagacgacgccatcggtggaccctagtccaacaccaaatccagcgccggaaccaataccagagccaaacccgacgccagatccgaatccaacgccaacaccagagccaaacccaacgccagatccgaatccaacaccagagccaaacccaacgccaacaccagagccaaacccaatgccagatccgaatccaacaccagcaccagttgaccaagccccgactatatcctttgctgatgacctgcatctgcatttaggtcaaaaatccttcaatttaatggacggtgtaagtgctcatgatgtagaagatggtgatttgaccaacaaggttgtgtatggcagcactgtggacgttaatacggaggggacttatcaagtgacctaccaagtgacagacagcgcagggcacaaaacgagtgctacgcgtgatgttgtcgtgactaatgacgctcccgttattcatgtctcggggaacaatcaaactgaagttggtcatgcctttgatccgttacaaggtgttacggctgatgattatcaagatggtgacctcacaacggaaatcaaggttgcaggagacgttgataccagcaaacttggtgattacgaactaatttataccgtcactgataagaatggtgctgtgacaacgctgaaacgttcagttacggtgtttgccacggcaccgacacttgatgtgtcgaaggttccaacggaactcaaggtgggagaccagtttaacccgaaggccaatgtcacagcggttagtccttatggcgatgtgattgtggctgtagatggatcagttgacaccagcaagcctggtagctatgagcttgcttatacagccactgacaagtttggacagaagaccgtcaaggaagtaactatcaacgttgtggctgacaagccaacccttgatctgtctaaagtaccgacaaaactcaaagttggcgatcactttgatccaaaggctagtgttacggctaccagttcttatggcgatgtcactgttgatgtcgaaggttcggttgataccagtaaacctggcagctatgtgctgacttatactgtgacggataaattcggccaaacaacaacgcaaaatttgaccgtaacagtcagtgaaacggtctaaaaagggtaggtgaatcaaatggacaaccaagcagcagagtatgttctacggttaagcaccttgtccgcgcaagcgctccttaaagcactggccgtcaagttgccaagtaaagcaatggatatgagcaaacaagcaatccatcatcagcgaacgactggtaaacaaaacattgcggaattgcaaaaaaagggtgcgctagaacacgtggatattagtaaaaccgatctgcgcgcgctcggaaagaagtttaaaaagtatcacgttgacttttctatccgccgagacaaggaaacgggcatgtaccatgtcttttttaagggtgctgatgtagaccgagttcaacttgttttgcagaaggttgttaaggactttgacaaaacacccgaacacggccaaacgcttcaagaaaagattgaaaaggctaaagtgaccgcaaaggaacgcaatcaaaaagagaaaaagccgcgacagcgtagcaaggaacgtgagcgctgatggacaaagaaaaagcgaaaaacctagtctggaatttcggccttgtggctattggtagttctgcggtatatatcgttggcagtggtttaacgcgagccgtctataacgtccaggacaaagacgctaagtctatactcgacaaaatactgtacgtgtctaacaatcttggcaaggtttcttggtggccgccgactttcaatggcaaatcattcctaggtggtcttattctactggcagttgtagcgctggtagttttatatgccttgaccaataagaaaaattatcgaccaggtgaggaacacgggagcgcaagatgggggactcataaggatattcttccatttgaggataccaaaaacccagataacaacctgattatgacggccacggaaaagctgtatttgaatgacttggatcataaacggccaatgagactgcagcgaaatcagtttgtgacggtcatcgggggtgctggttctggtaaaaccagaaccgttgtcgtacctaatctattgcagcgctccagctcctatgttgttactgatacaaaaggacagacgcttagatgggtgggtaacttttttgagaagtctggctatcagattaaggtctttgatttggtgactcgcaaacacactgatcattttaatgtattcgcttatatcaacaatgaggatgacgtcattgaagttgtgaatgcgatcatgcaaaacacaacctcaccgcaaagtaaaagcgatccgttctttgataaaggcgagaaggccttgatgcaagccttgtttgattatttacgtttagaagctggcaaccctgacaaccgtgtggttgcaaacgtacccaatgttttggacttagtcagagcagcaacaattgaggaggacgctggcgggaacacaacgccacttgacttaatatttgaagaattcaaaaaggacttcccggatgcgtttgggcttaaacaatatggtatcttcaaactcgcaccagccaaaacagccatgagtatcgtcatttcccttggtgttcgtttagcaccgtttgatgtgcctagtattattgatattactagtgacgatacattagaacttgaaaaattgggagatgagaaacggattctgtttttgatcctacctgatcaaagtgaaacgtttaatttcttggtcagcttggtttaccaaacattgtttactactttggtagaacatgctgaccatcaggtaaacggccgacttaatgaaacagtcgtttgttggcaggatgagtttgcaaacagtggacagattccgcaatttgacaagcgtatcaacaccttgcgttcacggggtattttctgcgtggcaatcgtgcaggaactcagccagctcaaagaacgctatccgaagtcataccaggcgattcttggtgcttcggattcactgctgtatcttggcggacacgacagtgaaaccgctcagtacatttcccaaatccttggtaaagggacgatagacgttcaacgttatggtgaatccaaaggcaataatggttcattcaaccaaaactacgacaaaatcgcgcgtgatttgttagcgcctgatgaagtcgatcgaatcggcggcgaccagagtatttacatgctcagaggtgtaccgccatttttgtcgcaaaaataccagttggaaaaacacccacggtataaagaacttcaaatggataactcagactatgtctatcagcctcaacttaaaatcgagaacaacaaaggaggtgaggtagaaacagaagaatccaaagcagagtcagatttcctggctaatatcagtcaagaggaaaccaagaatgatgcggtcaaggagaaggaacccgaagcggattcggatatcctagctgatgtcaatctattagacacgtttcgataaaaaaggaggaacaacacatgaacgttttatctcaagctatttctttaatgtcaaaatttgctattgcaggtggttctatttacgccgcttggggcttggttggtcttggtggtgctttgaaggatcacaatgggcctggtattcaaagcggtatctggacgattgcaggtggcggtttaatcattgctgctggagcattgttcaactctatttcactaacgtgatgtgaggaggcggaaccgcgtggataatacgatcaagggatttattaagtttatcttgaactccgtttctggttccgcaaaggctaacggcattaccgaaacgttggcagggtggagcaaggacttatacggattcgcaacaacgatccagactaatgtgatgatgccggtcggatatatgattctggcgttgtttgcgttgctagaactatatcgaatttcggaacaagtagaagctatgggaggtggatcagatgcaggggtcaggctgatttcagccgccttagtgaaggtggctttttgtaagattgcaatggatagcatgaatttattcatgaatgccattatgcaagtgagtatcacgctatcacaggatatcggtaagttagtgaattctggacatatgggcaccattattagcgttgatgatatttatagtcccttagtaaaagaaggtttttggacgaagctgatgatcatggtgcttcttctttttgtcatgctcattaccatgcttgccacagtcttagttaatgttgttgtcaccggccggtttttacagatgtatgtgtttttggctgtgtcacctattccaattgcaaccatgccccatcatgagttttcagggattgctaaaaacttcttcaagagcttcatggcagtatccatacaaggaaccctcatttatatggtgcagctgttctatccattcctcatgaaaacagcatttgcgaatgtcgataaaagtggcgtccttccattaatagcatcattgatgggattttcaattctactaatttttgcggtcttccaaacaaactcatgggcgaagtcgctgacaacagcaatgtaggaaaggagtgagtaacagtggctttacgcgtgagagtacccaaagaaatcaagacctacaaagaacgtatcataggcacaatggatttgcggcaactaatctgtgccacgatcgcattcatctattcagcgggcattatctatttcctggtctggaagttgcactggtcaatggatagtgccggtaatgtgctaatcccattggatatgccagtgttggcatttggctggatcaggccaaaaggaatgccattagaaaagtatatcggcatcatcttgcattaccaacaaatgaacgggctaagaatttatgaaaatcgaagggaggttagccttcatgttcacaagaaccgaggaaagatcaaagaatacaaagaagacaggccatagtaaagccttgaagttgttacaacgccacaaaaaggaacgtggcaagcaagagcggaaaaatgcaccatcaagagcaactcaagacagtttagcttatcgtgccatgtatgaagacggcctctgtgaagtggcaccaggtgttttttctaagagtgttgcgatctccgatattaactatcaaattagcgatcgcgaccatcaaagtgacatctttagcaaatatgcagagtttcttaatggctttgacagtgaatcgactgttcagattaacatcatcaataggcgaaaggacattcgccagttcatgcaggagacgtccttcaagcatcgacctgatgatctcaacgcgctccgtgatgagatgaaccacatcatgcgagaaagagttgaaagcggcaatacgagtctcctaaaggagaagtacgtaacctttacgcaacatgctgatgatcgacaacgtgctaaaaccagtttgaatcaactacaagcgaatgtggttaccagttttcatcaaatgggatcaacagcgcgtccgttgaatggtttgcgccgactccaacttgctaatgccacattgagacctggcagtgtgttgcattttgactatgacgatctcaaatacagtggcttgacgacacactcagtaattgcaccaaccagcttcaatttcaaacacgcaaagaatcgttttacaatgggcgaccaagttgcacaagtgttgtacttgcgagattatccacccgaaatcagcgatcgtctgattactgatttaacggatattatggcggacttggagattgccattcaaattcaccctatcgatccagtaaaaggcatgaagatggtgcagacgaagaaaggctttatgcagaagcagaaagctgatgagcagcagaaggcgatgaaagcggggtatgatcctgatattctaccggagaacctgacgcacagccttgatgaagctgaggacttgctccaacagatgcaagacgataaccagcaactctttgacgtgacattcctcgtcatggcacagggaaagaccgatcaacagcttgatgagattatcgagcaagttaaagcggctggtcgtagacatagctgcgaatttgcaaatctcgattatctccaagaacaagcccttaattctgtgctcatgtggggacaaaattatgtaccagtatcgcggacactgacaacctcagcggccgctatttttataccatttactgctcaagagctaagtgacagtagcggtttagtttatggcgtcaatcaagttacgcaaaacctggtgactgcggatcgtcggaacttgaaagctggtaacggcatgatcttaggccgtcctggtgctggtaagtcatttgccagcaagcaggaaatgctgtccgtacggttacgtgatgctgactccgaagtattgattattgatccagagcgtgagtattcagcggttgcgcaagcgctaggtggcgaagtcataccgatctcccaacgtgccgcagcgcatatcaatccaatggaaatcaatgaagattacggtgacgatgaagaccctgtcattttcaaaacagacttcattttgtctatgtgcgacatgctactcggtggcaaaaacggtctgtcagctgagcgccggactttgattgatcgtgcttgtcgtttaacgtatcaacgctattttgagcagcatacagcgatgccgacaatggttgatctatcaaatacccttaaacaacagcccgaagaagaaggaaagcaaattgcccttgagcttgagccgtatattgaagggtcgttgtctgtttttgcgcatcaaacgaacgtagacaacgacaattcagtggttgtctatgacgtcaaggatttaggtaagaacctacggtcaatgggtatgttgattgtgcttgaccagatttggaaccgaattactaagaatcggaactcaggcaaacgaacgtggatttacgttgacgaaatgcagctgctcttgagcagtgaatttgcatctaactacttctttgaattgtggtcgcgtgcccgtaaatggggcgcgttgcctactgggattacgcaaaacgttgaaaccttgctactgagtgataatgcccgccgcatgttgtctaacagtgaatttgtgcttttgcttgaccaagctgccaatgaccgcgatcagctcacagaaatgctgcatctgtctgaacaggaggaaggctatatcaccaatgccgactctggtcatggcttgatgattgcgggtgacgcagtgattccatttgagaatgactttccgaaaaagaccaagctttataagattatgtccacgaaaccagaggacatggagcaatatatttcccgcaagaaactgcatgaggatgggggcgaggtgagtggcgaataattggaaagacatgctgcttgataagcagcatcatgaccctaaagacgctttagtcagtagtgatccgagccggtttaagaaagccttgcgcggtaacaaatatcgcatacaaggcgttggcggctttggtggcaaacgttttgtccgaaaaaaagggcagtttaggcgtggccttttagcacaaaacgctaagcataaaaagaaacaggctagttgggtcaaacgttttcggcaccgtagtagagaagcgcttcaacatggcgcgattgaaacggctaagaagagcactgtactggcagctaccaatggtcagaaaagtgaagagcaaaacgatccaacctaccaaacgttgtcaaagacaacgcaaggagggagccgcttaaaagcccggttgaagcgccataggaatcgtaaaggcaagcgactagcaaaaaagttaggtaagccagttcaaacttcatacagccgtaaatcggtcagaaaaatgatgaagcagcgtgctttaaagggtgctaccttctcgtggcgtcatcctattagttcaatcaggcatctgttaaaggccattctgatgctaccagtcgtgatcaagtcgatggctattctcctattagtgggacttgtgtttggtctgatcgccttgatgagttccatgtttggctggttggtgcctacgatgtcgacgacagccgattctaagcccttaactgacgcctacagttacattacgaagttggacactgatgccactaagaaggtcattgacagtatggctaacacggacggaaacggacgttcactgattatcaatggtcaggaagcaacaacagatgggattgaactaatctcggactttgaccgtgagttggcctacttgtcgattaaatatgatgactttacagtagacgatgcgttcaaacaaaagataaaaaaattacatgatcaaatgatgtcggtcacagttgattcaaaaactgtgaccgtcaatttgtctagctttgatgagtgggagaagaaccatcctaaagtactctcacaagatgataaagatcggctagatgcaatgggtcaagtgggtcaatatcgaacgcaagagattctaggatcgccctttgaagatcagaatgcaacaatcatggtcaacgaccggtacgcctggcgaatgcgtggcggacaaaagaacatgtctaatcacattcggatttcaagcgagactggaaaaaagattgtggccgtgatgtccggcacagtgactgcctgtttaaatggaagtgtgacgatcgcaactgatggtaaacgaaccgtgaccggtgggctcaaagccgtgacggttaaaccaaaccaggaaatcaagaaaggagatcaaatcggaattagcgaaaagaacatcactcttcagcttatcaaaatcacgcagcagagcgctcctgacgagtcttcatcaaggtcatcattgtcaagcacctcagaaagcgtctctcaggcaccaggtttatcttcaaaaaactcttcctccgctttcagttcaaccgttgcggcaagttcagcacctttgccacccgttgaggaagaattaaatcctgcctttgctttaccaaatgtgaaatacacgtatgcgactacctatggactagttacaagtggaggcgatttaactggtcaggatttcgatgctaataaatttcacgttgcctgggttaagtatttttctaatggcgttttagcagacaaagaaagctactcaattgatgctgctaagaaagcgggcgtcaatcccgctctaattgccgctatcatgggaactgagtcctcttggggaaccagtgcagcagtgcgtggtgctaataatcctagtggtcagatgagcgggggaaccattattgcctatccatccttagaaggcggaattgatgccaccgggaacacgttgcataacttagttgttacccgtggtttgaatactgtccagaagttaggcgccgcctatgcacctattggcgccattaatgaccctaacaatctgaatcttaactgggtacccaacgtcaacaaacttttagccatttttggattcaagagtggtgactcaatcggtaatatcacgctgcataatggtggtaattcttatcctgtaggtcagtgtacgtggtgggcaaaagccagatccggatgggctgctaataactggggcaatggtgctgactggggtagctcagcagccgccgcaggattcagtgtcgatcatacccctcaaccgggcgccttagtgagctttgcggcaggccaaatggttggtaattggcaggcagaccctgtatacgggcatgtggcgtatgtggaatcagtggattcggataaagggacgattaccatctctcagggaggaacgggcttcaagcagcaaccagggccaaatttgcaaacgttaggaaacgtgggagcttacacctatattcacccacggtaaaaggaggaagacgatggaagaacacagatggcgccactggctattaccgctgtatgccgtgctaataacggttttgatggtcgtaggctggtatcgttggtcggacagtcaaagcgtcttacaagaaacaaaaacacatctgaacgcaataacaggcggtgaatcaaaaaaggtagataaaagagtccttgtttttgcggatttagtttttggatatcgtgcggatcaacaaaaacgacacgatcagcttgagaagctatcgaccaaagcgatagctgatcaaatcgtaccaccggctaatattggtaaggcgggtgtcggtccggatctgtcttataaggtgacgtaccagcatcgcgaggttacttatacacaagtaggttccgaaacaatcgcaatggcgcggttagcatacactatcaccagcgacggcaacaggattaaaaacgatttagtgctgcgcttgccgatgaagcagcaaaggataattgggtgcacgctatatcgtctcaatcaatcacaggcaagtcatgactaataaaggagcgatcaacaatggcaagtacgagtctggaaaagcgaatcaagagtaaagagaaccggatcaaagaactagaagaacagcaaaaaaaggtgcagcaacaattgacggccgcaaggcgtgatctcaaagtcttaaaagccgataaggttgacgcgttgttatctgagagccatctaacttatgaagacattgcgaagctacttaaaaaagaaagccatgatgaagcccctaggtttcattaatgatcgtacaagaggcatggaagggagggactgatgtgggtcggaaaaaagataaagagactgacaccatcaagattaccaatcaagaggggatcgcgttagctaccgacccgcaaccgtttgatgatgggctagcacagttacaagcggctagtgatcacctgtttgatttagcgcaacatggtagctgccaaatcacggcctatcaccgtgaccaagttgccttttccgtcaagattaagctaccgattgaagggaaaattgaagatctgatcacagacttaatttctcggcggcaagaggtaacttcaccaccagcaacagacgtttcagtagcgaatgaaactgaaccggattctgcatctgaacctgtttctaccgactcgttagcggctgatacaaccccaaaaaggacacgtaaccgatcacatagaaccgttgccaaaaaaccgaaacgaactgctatcaaattaccttcaatttcattaccaaaagttagtcgatcgtttctcaaacacctgataaccattgccgttttgctgataatagcaggcggctttttgtttggaacaaaactagtcgttgatgcgtacaacgcacccccaagctacacctccctgattaagaagggggactaccttcaagccggtaagctatatccgaatcgacgggacgatgtgcgtaaaaccctcacagatcaaagtaacgtgaagcaactcgctaagtttcaacgtgtctacccaaaagctgagacactgtttgatcttgcttacctgcaacacgattatccaaaagtcatcgcgatgagtaatcgtgtgacgctatctcaggagcgccaagccaaactcgccattgcctatgttcacactaagcaattcgatgccgccgtactgattaacgagcagctcaagagcaaaacgctatcagaggtgattgcgctggggtatgtgcggaaaaaggacttcgataaagctcaaaaaatcaacgacaaactaaaggactcaaccattagtcaagcgattgaagtcgggaaaaagtatgcggctggtattgatgcttttaacaagattgcaagcgatccgaaacaacctgcagacaagcgacaacaagctaagcaaacagttaaaacatttgaacatgccctgagtacattaggggaaagtaacaattcaaattcgtaaaggaaagcgtgataaagatgccaacatcaagccaagaaaagcaaccaccaaagagtaccaaagagttactggcgttggcgcaagatggcgccaaaaaagtcttctctactgacgagtatcgagagtatttaaagttcatcagcgggtttcatcaatacagtgtcagaaaccagttactcatctatttacagaacccacatgccacttttgttgcggggtatcacacatggaaaaatcagtaccatcgacaagttaatcaacacgaaaaaggtatcaggatattggcgggtggtgaacacaagtacgaaaagagaattcggcaacctgatggcaccatcaaacgcataaaagagaccagggtattctgccgaccggcggctgtctttgattactctcagaccagcggtgagcctatcaaaatgttcacacatgagctgactggtgaagtaccaaattatgccactatttatagcaaacttgttcaagcaactgactttcatgtgggctttagccatgagatgccaagcagcgaaaccaagggtgttactcgcccacgcaaaaaagaaatccaattgcgttccggtatgagcgagaagcaaaccattaagacgctgattcatgaactcgcgcacagtgaattacattgtgatcccaagttaaaattggatcgttcaaccatggaattggaagctgaaagtaccgcgtttatcgtttgtcaacatttgggaattgacacgagtgattacacgttcccttaccttgctgtttggtcgaaagataaggatctttcccagctctccaaaagcttaacgcgtatccaatccaccgccgaaaaattcaataaaaccgtcgatcaaaaccttgaaaagattcgtgagaaaccgttgacgcttgatcaaaaaatagaacgcgctaaaaccattgcgacaacggaaaacatcgcaaaaaaagagcaagggctggtgcaagcaacgcaggagaaaacacgctaacccatttgttgaatactctcactcaagaggacactccagcccttgcttttctccagcccttgatcacccaagaaaggaattaccaacatgaaaaccattgatgaaatgaacgaatttgatcgtgacattatcttgcttcatcgcaagtctgtgagcgaagatacaccaccggcaattctacaaaaggttaaaacagtacgtgatgatatttctaatgacctgacgggtatcacagatccaattgagaaagaatttaccctcgaatgttacgacgaaacgatccgaaaattaagcgacctttcggtcgaagaatatcagaaatggctaggccaaaataagaacttagaagggtttgaactttgattttggagggtgtcgcagaccccttcaaaataacgggggattgggggcgtgcccccaaaacaaaattgactatcagcggagctgatgatgagtcaatttatcgcaagtgtacgtacacttgcaaatctcgcgacagtagaaaaacatcaaaaaagcaaaatctggaattcacagattgtgctcttttttaaccttcaatttcgaagctgcgtcactgataaatgacaaccaaggagtgaatcgaaaatgggaaactatgcaggtaacagatcacgtccagaacgtaagtatgtgacattgtcacacgatgaactcaacttcttaactctccgaattaccaagtcaggcaacccgccctttacaacttttgcacgcaactcgttgctaactagcaagatggttcatgttgagttcacgaacacgaaaaagatgctcgagcagttatcgagaatcggtaataacttaaatcaaattgctcatcgtgcaaacgaaactgaaaaggtgacaggagaagatatggccgaggttaaaaatgaagtctacgacctctttacagtcatcaatgacaacttgttgcatcgtcttgatcttgtccaacgttatgaacgggtggtcttaaatggcaatcacgaaaatacacccgattaaccgttcaaccaaggatgcaatcaagtacatcagtgacccactcaaaactcgtgatggtgagttggtcgaaggcgtccattgtgctcctccatttgctgcgtttgagtttgaaatgttagctaatatgtcgcacgaatacaacggtaactacgagcgcgttggtggtcgtcacgttggtggtcagcgtctacatcaagcagccaaaagctaccacttgattcagtctttctcgccagacgatcacgtcactccggaggaggctcacgagatcggtttacaactcatgcgcgaactgcttggcaacgattaccagtttgtcattgcgactcacgttgacaaagatcatattcacaatcacatcatctttaacgcatactcgatgacaaccttaaagaagttccggagtcaaccttacatcacggctaatcggatcaaggaaatcagtaatcgtttgaccgctgagcatgggttgtccgtgtccttaagacgtgatgaacaactcgataaaaatggctttgttcacgataaggatgttcaccaatcattccgtgcggagttgcgtcgccgactgcgatttgttgcgtctcgtgcaacatcaccggaaatgtttgaccagctatgtgaacagctagaaatcacgacaacgaagcgtggtcaagatagggggtatcggttgcctgaccagcagcgcaatattcgcgacaaaagtctatctgatattggttcatacacgtcggaaggtattaaaacaaccactgctgagaatgctgacaatcaactacgattgatggccttaattgatgatgtctatggtatgtgtgacagccttgatgatttaactttcatgctgcaacaggaacatgatgttaccctcaaacggcagcgcaatggtagctatcaattcacatttcatgatggtactaaaatgcccgcggaacttctaccccctgcctaccaactaaactatatgaatgagcattggcatgaccccaatgctctcaaaacaaaggtggcagctcctgatgttttagccgagtatcaggaacaaaccaagtcgaagatgaccaacaccgaaaccttaatggacttgtctgaggatcaggtgctaagtgttgatgaaaagggggctttggttcaactagaagtgcctaatgaaggacagctaacagttcacttgaatcgttacgaattgcgcggtgattctgatcatttgcaagttgcgctacaagccaattattactacacattaacggatcaatcaggaaaacggccacgcgctgtttcaatccgtggtgaggcattgatacacgcgattgatcttgatcaaggattgaatcctgaactggtaaaagttcctcctcaagctgtctttggtcactctgacaagggactaacgattacgctacctgatgccggttatgaacgggtctttatccctaatgacgccgtaaattatgaccggttgcatcaccagtacaccgtgcaaattggcaatcgctggcactacaatgcaacgccctttgctacgttgaacgatccagaaccaaaatcagttagtttgacaggagccgcgttgaaacctgcattaaagtcaacgcagccggtgttaggacgttggttaatagccaatcggcaacgtcaatatatgcaagctcagcaagctgacgtgaagcgcttgtcaaccacgcttggtgaattgagagccaaccatatcactgaccgtcagtcattaggccggcaggtaacaacggtcaaagcgcagctccatgacgtgcagcagaaaattgaaatgcttcacgataagattaccagctacaacgacttagcaaagttcatctttacccgcaaccaatatcaaccaattattgacaaattagaggacgtttcaccaaatgagcaacaccggctcactaggaagtaccaacatgaaataaatatgtatcaaaccgccgtgctacatttgcaaaaccaagactttaacccactactgattaacgaagaaatggcgagtgtcatcacagaccaagaaaaaaccctacggtcattagaacaaagtctcaagcagcaaaccatcatggtcaacaagtgggaggacattgctgaattaatgaacaatttacaaggtgaaccgtcccaggaagggcaagaacagcaacatcatcatgatattgaacgataggacgcctaggcgtccttttttgatgcagaaaggagttaaccgagatggtcacaaacaaacagaaacgactcagtaaagcaacgattgaccacgcgaatcacgttgccattgtggcgattgccgaagcgaatggcattgccctagtgcaacagtccaatggctattggcgtggggtcgaacatgactcattagtcattaatgacaagaagaatctcttccgttggaatagtcgcgatgttggtggcggtgcattagattttgtgcagcattatttaggcatcagcagttttcgcgaggcagttgcgtatctgaatcatgcagctttagagcgagctgaaactatcacgcataaggttcgtgagccgtttcaatacaactttaaaaatagtcctaactttgagcaggccactaagtatctaacgacggttcggaaacttgatccacaaattgtggacttactgcatcgcaaaggctttatccaacaagacgagcatggcaatgccatctttgtctggtcaaggaatgacaaaatcgtaggggcaacggtacaaggcacgagaattgaccatgagcatttgggtaaacggggtaccttcaagcaaattgccaaaaactcacaagaaaactttggcttcaatttgtcactaggcaagcctgaacggcttttaatgtttgaggcgccgattgatgccctgagttattggtcactgcatcgtggcttgaatcacgtcacgttgatgtcgatggacggcttgaagccaaatacggtcaaacaagggctgatttatttctgcgagaaaactggtcatgggccgtcagagattgcttttggggtcgacaatgacccgagtggtcatgtcttttatgaccagatgcgggctgaacatgctttagcgagtgtgccgtatacgagtctaatcccagctgaccaagcaattccacacgagtgtctagcaccagttgtcagtgctgcaaagcaggcagccattcctaccgtcgctttgatggcgtatctgaaagtcgccgtcaatttacagcccggtcacggtatagcaaacggctatcattatcaggatgcccttaccaaaggctcttttgcagacttacctgaaattgccacacagctcaagccgtatctacaatcgaacggtatcgattggcaagcctactttaagcaacatgcccctgatttagcatcaacggctcgtaacaacctagtcggccgaatcaaaggagttgcgcggcaataccaaaacggagattttcaggtggttcaggacgttccaaaggattggaatgatcgactacaaatccatgagcgttcaaagagcaaaggtttgaccttggatcaaaaaatagcagcagcaaaagaaagggcagtgacggccaatcttagaattgcacccaagcattatgatcaagcgctggagcgatagttttctattatcgggtctgcgagctttttggcgtcccttgtctcgacgtaacaagacgaggtggtttccctcgtccgttacctaacagaaacttgattggctatatgagacgacgtagtacgttgcctagagcgcgtgggcggggcaggcgccccacgctcctcggccttggccgactaacgttaagccaaaaagctcgcagacccgcggacaccaaaacggccatatcccttgtggctctaggaatatagccgtttatgtgctataatattattagcagaaaagttaatgacggttggcaaatccaatcacaaagaggtggtcgcctatgaaagacgtccaaaatctaagtgaagggaggtgcctgtttgtccgatgctgagaacctgtctagtatcttttaagaactatcttcaggaaggccaatacaaccatttgaagactgctgttaagggcacgttcacagtttttccaaagtcgccgacatttatctagccaactccatgaacgttcaacgatccatcgtttcggtaacaccgtgaacatatgcaactcgttgcgtttagctaccgtcgtcttagcgttcaaaatgagcttcacctgatccgcaaagtcattgccagtgtagccatcatcaaccatgacatgctgaaccagctctaaattttggctagccaaactaaacatagccaatgcacctgaacgatctgatacattagctcgtgtcacgagaatggcttgtggtaaaccattaatatcaaccgccatatgacgcttaatccctgaaatctttttgccgccatcgtagccactatttttcgttaaatcagtggttttaacactttgagcatcaacaatcacaaacgacgttcgggccgatcggccctgtgcaaagcgataggaagcaacagtttttttaaaagcctttctaatagcgaatcagctgtcgggtctggtttatctcgccacatatcgtaatagcggtagacagtgtgccattccgggaaatcgtgcggtaattcacgccattgacaccctgtagtaagcgagtaaaggatggcattgaatacgtcataaagatcataacgacgcggtcttgtatgcttgcggaagttttctaaatcaggttgtattaacgcaaattgcgctcgagaaatattgcttggataatctggcatgacaaactcctcagtcggttttccacaattctaccagattcagcagatactagacaggttcttagtatcaacgccgatatgatgtttaatgtcagccttctttttgtcaccatcgtagcctttgcactcggctggatgaatattgcgagtactttgggcttcaatgattaaaaatgacgttctagctgaacactcttgatcagtcgatgttacgcaacagttttcttgaaactcgattgaacttagtgagttcatcaaggctggcaggctctttctacgccaacaagtaatagtaaacggtttgccatttaggaagatcagatggtaagtaacgccaaatacagctatttttcagggtataaagtatggcacagaaaacatcgtaaaggtctatttgacgatatttggtgcgttttcgggtatttccataatctgaacgtatcagcttgaactgttgacagttaatgtcactgctgtaggaggctaaatgtttgcattggcgataactctccgttttttaaactagactacctgaaattgtagaccccaaaaatcaactgctctttgctgtataatttagtaaagtttaaaatgtaaagatatcataaattgatagtgtaatattgtgctattaaataccaaggacggcggctatgaacacattttttgagcagattgcgaggcattacgaaactctaagtagcaacgaacaactggtcatcgattttgtaatgagagatcacaacatcgatcgattaaagattaagacgattacggatgcactttttgtctcaagtgcaaccgtgatgcgtgccgcacgaaagttaggatacagcaacttttctcaactgaaatactcggccgcgatgacgcaagacgaacaggcagccccactaccttctgaagattttgatacgattacgggaagaatcacgagtgagtttgataagacgctgcagatgttgagcgaagagaatgtcgcagagttcgtcgagcacctcaatcatgcgcggcgaatcttttgcgtcgggagcggatcttccgtcagcgtcgtgggtgattttacacgcaagttgaagctgcttgattattggatcaatgactttaatgaactttattcgatccgagatattgcaggtttggccgaagctgacgatgtaattgtgatcctttcacttggtggagggaaccatcttgtgaaccagtttttggttcgggctaaggcaactggagcaaaaattatttcaattactggaattggcgcagattcagtggcgaagttctccgattgcaacatccttgtctaccaagaagcggtgccgcgtaagagaatgcgatcgcaattaatgcttaatgtggctatcgatattatctttgagtatatactgtctcatccgcatggacataaataactcacatagtcaaaaaaaactgttgagggcgcttttgtgaaagcgccttcttttttaatgcttaatgctacgataactgtgaaatcgtgttatacatgaataatagggggctatactatggcaccatcaaaagcgcgtagaaattggactaaaggatttgagatgtttgggcgatcgttccttttacctgtctcggttcttccagctgcggggattcttcaaggattaggttctgcatttacaaatgccgatactatcaagatgtatccctggatgcaaaatcaagtattccagttcgtgatgggctttcttagtaagatgggttctgctgcctttaacaacctaccattgatttttgcggttggcgtggcagttggtttggcaaaacacgaaaaaggttcagccgcagtttcaggtttactgggctttttaacactccatacgatattaaatttccttctttctacaaccggccaattggttaacacagcagggctgacggacacggccgctaagctggccttagccgataagatgcaaaccacagttttaggcatccaaacgatggacttaaacgtctttggcggtatcatcactggggtcattgtctactttgtccataagcgggcaatcaaaatgcacgttccgaaggtcttagacttcttttccggaccacgactagtgcctattctcatcatgccagtaatgtctatagctgcggttgctttcttcttcgtttggccgacagttcaggcaggaattgccgcactatcagtattgattcttaaatccggatcgattgggaccttcttgtatggggtcgtggaacgattactcttacccttcggtttacaccacggattgaactggccggttcgaaccactgagctcggaggtatcttttatattggtggacaagagtaccagggaacaattgctgcatacatggctgaacttgctcatggtggtgcaatcaatccaatgattaccagattttccagtggcaagtttgtttacaatatgtttgggctcactggggcggctttagctatgtatacctgcgcgaagccagaaaacaagaaaaaagttggttccttgctgtttgcagctgctgcgacggcctttctgacaggggtaactgaaccaatcgaattcacattcctgtttgttgccccggcactgtatggcattcatgcggtactggcaggaacgaccatggcagttacttcagccttgggcgcacggttcctgacaccaacggggcacggtttgatcaactacattatttatggtgtgcttcagggaccgcggacgcactggtggatcatgccaatagtcggagttttctgctttgtcatgtactactttgtctttcggttcgcaattatcaaatttgactttaaaacgccgggacgtgaagacgatggtagcgagattgttcttcatggtaaggatgagacccgtaagaaaatgggcgtgcacacgctaaaagataatcaaccagccgtatcggttgcatctgctaaaagtggcaaaatgacagatcacgaccaagcagtggcgctgattagggcgcacggtggtcctgataacattgaagcggttgatgcctgcatcacacgactaagaatcaacgttaaggacaagagtctcgtcgattcgaagacaattgttaatgatcttggggcgatggggttcaatcagtctggtatgcagagccagtcgatttatggcggtcacgcgaacgttttgaagatggagatacaggatatccttggtatgacagaataggaatgattagcaatggataaaaatgcgatcgtaataactgacctagatggaacctttgtctatgattcacatacaatcagaccaatcgacaggatagcgttccacaagttacaagaacgcttctacgttggcatcgctacaggtcgatcaccgaaagagattgcctttgttgaacgtgtcgggaacctacatgcagactataagatctgttttaatggggcaatcgtcgaggatggtaatggaaagagaatagtggatcgaccaattcctcagactgcattgcgagcggtgatgcaatatctcaaagcaacagcgctgacgttcgatgcccttgatggagagcgaagaattggtaattatacaactaacgataagggaagattgtggggaatgaatttgatctgcttagcagagccgcatgaagctgtagctgcggagcgtatctataaaatcaatgtaaggccaggaagtgtacacttttatcaggtgctttctgagatgcaagaacactttccagagcttggtctctatgaaagcgatgggaaacggatcgaagtaacggctaagaacactaataaaggcgaagcaatcaaaacactaaagatgggattttctggaaacgtcgttggtgtgggagattctggcaacgatgtccctatgtttgaagcagctgaccaagcgtattgcattaatcaggcaccacaagcagttaagagtcacgcagatgtggtgttgaaccacttcgcagatttactcgattaccaagacgcaatcaatgcatgacaggaggtgtaatgatgtttaatttatttggaaagaaaagggcacccttggcgcttgcagccactgccaatggaagagtcaagcctctttctgaagtgaccgatccggtttttgctagcggcatcatgggagcaggttatgggattgaccccgccagtgatcgtatcgtctcaccagtttcaggtaaggtgacgatgatagcgaacacgttgcatggtattgggatccatactgaagaaggtttggatgtcctgattcacatggggatcgacacagttgaattaaaaggtgtgcccttcaccatctctgtgaaagtgggcgagcgtgttcagtctggacaggatcttgcaacgatgcagcgatcgatcgtcgaggcttcgggaaaaagtacaacgattattgttgtggtgaccaacagtaaagatttagaactggcggtcgaagtgaatgatggcgcgattgaggcaggtgaagtggcagcggttattgaactgctgtaatagaacgcactttttaaatattggttccaggccagggctatccactactagttctggccatttttatgtactgtaggttaagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatctttatgacgtattcaatgccatcctttactcgcttactacagggtgtcaatggcgtgaattaccgcacgatttcccggaatggcacactgtctaccgctattacgatatgtggcgagataaaccagacccgacagctgattcgctattagaaaggcttttaaaaaaactgttgcttcctatcgctttgcacagggccgatcggcccgaacgtcgtttgtgattgttgatgctcaaagtgttaaaaccactgatttaacgaaaaatagtggctacgatggcggcaaaaagatttcagggattaagcgtcatatggcggttgatattaatggtttaccacaagccattctcgtgacacgagctaatgtatcagatcgttcaggtgcattggctatgtttagtttggctagccaaaatttagagctggttcagcatgtcatggttgatggtggctacactggcaatgactttgcggatcaggtgaagctcattttgaatgctaagacgacggtagctaaacgcaacgagttgcatatgttcacggtgttaccgaaacgatggatcgttgaacgttcatggagttggctagataaatgtcggcgactttggaaaaactgtgaacgtgcccttaacagcagtcttcaaatggttgtattggccttcctgaagatagttcttaaaagatactagacaggttctaatgaaatcgtcattggtggcgatgagcccgataatgctttaaaattgaagacgttatatcatgaatatgcgcatagtcagttatatgggttaaaatcagcctttaaagatcgcccgcgagcctatcaagaaacgcaagccgaagcggtcgcatatgttgccatgcaaaatattgacgttgataccagcaactactcactcggttacgtggccacctgggccaaagataaagccgtaatccatagcgctttaagtgagatccagcaagtgagcaacaaagtgattgagcttagcgatggcttaaccaaacaattaggcttacaagaagccccaaaagagcctgcgcatgatctaaaaaagctatcagcccatgatcttaataagtcctatcaaggcttgcaacaacaagttcagcaagcaactaatccacaacaaaaatcagaactacaaaataaattaaatgatgtacaccatgaaatcagtaatcgaacgcaaaaacaactgaaagcattttctgaacaaaacccggcaattaaacaaccagaacataatgtagctaaaacattgaaaagatagggggatttaacactatgaaaattgttcttttagatggatatgaactaaacaaagatttaaattggaaaagcttgcaagaattaggcgactgcactttatatgatcgtaccccagttaacgataacgctgaaatcataaaacgaattaaatatgctgatatcgtcattacacacaaaacacccctagatcatgaagtgattagcaaaacatcacgattgaagtatatcggaatcatgggaaccggttatgatgtcgttgatattgagagcgcacaccagaacaaggttgtggtgactaacattcccacatatgcaagtgatgcagtggcacaatttactttctcgttattattagaagtgactagccaagttggattgcataatcagcttgttcatgaaaaccggtgggcacaggctcgtgattttactttttgggaaaaaccgctattagaattaaaagggaaaactttaggaataatcggttatggccatattgcgcaaaaagttgctaaaataggacacgctttttctatgaaagttattttctataatcatcgtcctaaaaaggttcctgaatcatggattcagcaggtttcatttgatgaactattaaggcaatctgatgtgcttagtctgcatgtgatccaaacaccagaaacaattgatttaattaataatgatacgattgccaaaatgaaaactggggttattatattgaatacggcccgaggcaaattggctaatgaagcggacatcaagaatgccttgaatgaaggcaaaatttatgcctacgccactgatgttgttaaaggggagcccattgctagtgatagcccattattacaggccaaaaattgttatattaccccacatattgcttgggcaccatatgagacaagagaacggttgttgcatatgactgttgataatataaaagcatatttatcaggagatctgaaaaacgttatcaattaatggcaatggtctgtgaattcttttgcctacattgaagtaaaactgtctaaaataaagcaattagaaaaaacagagccagcaaataaagtgttaagaaaaatacggagagctagaattttatagcttctccgtatttttaaaggccacattgcgaatttcttgtagtgggataaaccgatcagcgtcaatcacaatatcattggcattgtagccacggatcaaggtggtgatatctggcaaatgacggttgttttggtcaaccgtttttaattgaatggtcactggttgctgacgctgatatgcgtccgccaatacctcggtaattactgctaaggattgttgcggtcttggaacgtatactgcattcaactgctggttctgttggtttaaagcggcagtatgatcagataaatagaacccctgccatttcatcatgccccggtcatgataatcgtgttcaaaaaaatgcttaaccgtgcctaaatcaaagtcttggttattcaaggggcacccgctttcgttgaatcagcttttgacttgccggccaccgttctcctgtaaagccgacaaattcgatcgttagctttatatcttgtcgtaatgcttttaacagcttttctaaatcagctaaatcatagtgtgctaatttatgtaagggaacggattgcaagcgctcgttagcccgttgactgttaaaaaacagattataggtctgatcgtaggtatcattagtcaacattaaccaatagcgggtttggggacaccgcttaaacaatagggttaatcgccccttaataatctctatatcgctattcatagctattacctccattatgtccgcccactagtgaagcccgcttgatagcggtgcccccctttaataaactggtcgcgtaaactagtttggtgaacccaaattgccggtgaatttcatcaatcacctggtttaaccggctacggcgaatttggttgcgcggtgtttcaaataaattaagttgttggccggagttggcacttagtttactgctataaacgccaatattccggacagcttgaccgtcccaattctgacggaataaccacaataattgttgcgtcaaaacttgattgtcgttagtcgggtcaatttttaaagcttggtgaaagccaccgcgaccatctgcttcagctgcggcataggaaaacccaatgcttagcgatagacaccccgccagtttatggtggtgccgaagccgcgccgccacctgttccccaatttctttaatgacggtttcaatttcgacttggttaaaataatctcgtggcaatacttgcgaattacccaggctagcttctttaaccttagttggttccgtaacttgcgcgcgatcaattccccaggccgtagcaaataactggctaccaatgacgccaagctgctgtttgagtaaataagggttggtatgggctagctcatacatattgtgaatgtgaaggcggttcaaacgtttcgccatacggggaccaatcccccaaacgtccgttaattcagtaattgaccaaattttatccggcacagtttcgtaatggatttcaccgatcaattcatgattatgtttagcgtaaaggtctaaggctaatttagcttgcaccggattgtcaccaattcccacggtggtatacaagcctagcttttgccgaactgtcttttgaatcaagcgtgccacttcgcgaacggaattgccaaacagccgccaagtatgggtcatatcaagaatgctttcatcaattgaatacggccaaacctctttttcagtagtaaattgatgaaagatctgattgatctgcaaattacgttgaatataaaggttcatgcgcggtggcacgacccacaacctggggtcattgggtaagtcacgtttacgggagacgttggctttaagatgaaataagtgcttagcttcgggtgacgtggctaaaatgagtccgccattggtattttcagcttcactaaggaccactaatgggacttttaagggatttagcccccgggaaacggcttcgcaactagcataaaaggacttgttatcaattaagaagaacacgccatgcggttcatcatgagtaaacaatttcatcacttccgttagcttttacctgtattgtagcacagagggcaaacatgtgttccctaaaaactgctagaaagctgattaaaaatagtcgaaaatccattatagtcatgctataatgtagacagaaaaagggaagccccgctagaacaggacttcccatgcaagccgcttcaaaggcggtggcgaagttaataagacagcattaagctaccctgtaactggccaaagttacgcagggtggcttttttatttgttccttttgtcgatgtacgttagcaacgctaaaataaacattgcaaatagcaacatcaacgagagtgtctggaagacgctcattgactgtgaaaccttcctgaagattattccatgttcccatgggcctcacctcgcaagggaaaagacagccaccgcccttaaaacttcctgcgtaatccattatacaggtgaattaagtgttgaccaagcacaataaaaattaagtcatggggtttcataggatcctaaatttgatcaaattaagctcagcaaaacatcttttgtagataccctttttttagttcctggagtttttcaagcttacgctgatgaagagtgatagtgttgtccaatccattcagaagctcagcgagcttaacttgttctctctttcttgggagcagaacaggaaaatcaatcaagatgttctgattgaggtgcttgattgttccaccggtcgacttggcattggcatacttcattagaaacggggctgccaagtattgataaacataatcaacgtcaattgtctctggatcctttatcttgacattgaagactcctgcatttaatgttgctggcatgttgaggccttgaacaagggctactttgcccaaggtcccatcctttgttataaggatactaccattttcgacttgtatctttgtatcttgctcataccgatttttttctacatagtggaccgtcgaataatcaaccgtaccgtcgtgaaaatttgttcctgtgattaacatataatctccggactcgagaaactctgatgtacgcaaattctgccacccaatccgagcatttaaggttgcaatgtcagaaagcttacgctgttcccaagcgtcagcaaaccctgcaaatcttaattgcgggaacttgctaccatttctggggaacaatttctgcaaatagccctgtttaagttccttaagcttagctaacttacgctgatgaagagtgatagtgtcgtctaactgtttgaaaaatgagccgattttttgttgttcatctactatcttaggaacaactagtagagtattaaaaaaatcagtaggtgcaatatttagtaacccatgattacgagccccttctgccgcattcttagaaacctcccggtaccatctagtggtatcgtaatatgaaactagaaactgagaattgattttcgtaggtctaaagactatataaagtgtcgatagaacgcccatatcatacttatctaaacgcttaatagcgccccatggatatccatttgaataacttttattatatgcaaactcaccatttttaactaaaaaatatccagtaacatcacgactcgctacttgcttattgaaaaaatcattttgatctaccaaaccatcttgtgcagatattgttagcggaagagtcgactcattatttttgttttttctagtaacacgctctgagatgctagataacttacgctcttcccaaggatcagtaaaccctttaaatcttaactgcgggtaactagcttgttgatctttcatttgtgggcctccggttttgactggtcattaacctgggtggtcactaactggctagctaattcattaaagatttgttcattctgactgatttcctcgtccagttgctttagatcagctttgacttggttcagatcaatctcgggttccggctcaaacgtatcaacgtagcgcggaatatttaaattataatcattcgctttgatttctgccggtgaggccacatgggcatatttatcgacatcctgccggttttgataagtggtcacaattttttgaatattcactgccgttagcttattttgattcttgtccttttcaaattcccgggacgcatcaataaataagacgtcgtcagtggttttgtgtttctttaaaatcatgatcaacgttggaatactggtggaatgaaaaatattggcgggtagtccaataatggcatcaatccggttatccagcaggagtttttggcgaatcttaccttccttagccccccgaaatagcacgccatggggtaagacaatgcccatagttccgtgctcctgcaaatgataaaagccgtgtagcagaaaggcaaagtcggctttagatttaggcggtaagacgccatagtcgcggaagcggggatcagacaaacgtttgtcactattatcccagtgcgccgagtagggcgggttcataacgaccgcatcaaataagtaaggttcgtcaaccggccaatctttacttaacgtgtcgccattgcgtaaatgcatatcgtcatacgagaccccatgtaacatgaggttcatacgggccaggttataggtcgtggtgttcaattcttggccgtgataactcactaaattggggtcttgcacgtgctgtccgacatttaatagcagtgaaccggaaccaaccgctggatcataaatagttcgaacttgtttgtcacctgcattgcgctgataagtcacaatctgggcaataatgtcggacacctgccgtggggtataaaattcacccgcttttttaccggaatcactggcaaattgcgcgattaagtattcataggcgtcacctaggacgtcgccttgatggtggacaagatcaattgcatttaaagccaacatagtatcactaatagtttggttacgttgttgtaaagaactgcctaatttattactacttaaatccacatcggcaaacaagcccgaaaagtcttgcgctgaagacagattttgcgtcgactgttccagatcatgaagtgcttgagataaatcgtctaacgcaaaagtatgggcttgaatcttgccaatcagggtggtgtacaacgcttgtggttgaattaaatagccgagcgtgttttgcaaatactccactaaactgggctgcaccgagacgccttccaactcgaactgaggatccatatactgagcatatttctgagtgacattttcggttttgcctgcccaatcactaaaagtcgttaaggttttctcggatagaaaccgataaaaaattaaccccaataaataatttttatattcagaagcgtccattttcccgcgtaagacatcggccgcattccatagggcgctttcaagttgactagcttgagttgttttttctgacattgtttaacctcacttatttttgtagataaattgctaaatcgtgttcaataaactgccgccaagcggcctgggacttaatccggtatagtggcaaaatagctggaatcttcggcccagcggctgtttgagcttgtaaggccgctgctaaattcgctgactgcgttaattcttgttcatgatgccattcatcagtacccacggtgtgttcacgtgccacccgtaatagggttgcttgatctaggccccacgtgtgggcaaaagccgtcgttttttggaccaattgtttctgggcataagcggccaccaactcccgagcattcaacgctactggcgcttgattttggtcactctgttgctgagactgttgcatttgttgctcaatataaggcatggcttcgcgaattaattgagcctgttgcggttgcgtttccgctaatttattcaaactagcctgtactttggcactattttgcaggtaatcggtcatatgggcttgggcttgatcaggtgtcgtgtactgttgctgttcatcaatccaatcttgaattaattgcgtcaaataatcataatccaccaagacgactgaaccaacggctaaggaaaagtctaaagcggccaactcttcggggactttctcaggctcttggttagtaaccgccgctttaatccgcagatatttacccgtataggattctacttcgggctgagcaataccaaaagtcttttcgctgttctcccaagtgaaatcgttgtacatggataaggaattcaattgttgattcacttggcgaaaggctttcacaaactgtaccttggcagtagttcctttaaggtcatcggcagccgtcggcgttggagcaatggcttttaaatccaccacagccttttgaaattttaagacggcctgctgataagtgggacgaatgatgacattaaaagagccttcgccactatataacttataagcttcacgttcattcgcttccatgattgccggcacccgaaaggtcacaatttggccttcttgttttaattcccggttttggagccggttggtgcgtgagtaggcttgaatgagttcttgataagctaaggtgcggtcaacaaagagcgtgtttagccgaggggcatcaaaacccgttaataaccgtcgcaccacaatcactaaattaatttcctgatcgggttgcaaatgagcaaagaccgcctcacgccgggcggcccgttttgcgacatcttcgttgtagagattcaaatcggctaaatcaaaattagtgtgatactgccgattataatcttttaaaatggtggccatttggtcatgtttttgcgcactctgatcttcgttttcacttaatgaataagtaatcgcaattcggggccaatcaggatctagctgattgtgagtagtctttttcgcggctttaaaggcttgataatagcgttgcgccatttcaatggagctggtggttaaaatcgcattgtagttgccatgccccaagctggttttacgtgggcctttttgtaaaatatattgaacaacttgttggatatgttcatcagtctcaaagtcagccggagttaaatacgtttcttccaagtccttgactgacatcgcttgaatcttggcttgaatttttgcttcatcagctgtactcagcaggcggccttgcttatcgcgacgtgctttgacgcgctgagtttctttttcgagggcccggattattaacgtgtctttcccaatcgtcgttacgtgttccacgttaaacggtaacacggcttggtcctctaaggcatctcgcaagttataaacgtgacagactttaccaaatagctcctcagtcgtgaccgctagatcacccttgagctgttttttattttcattaaagatgggggtgccggtgtaaccataccagttactattgataaacgctgctcggatttccttttgcatcttaccaaactgcgaccggtgggcttcgtcaacaaagaagattacccgttgctttaaagtcttactaaagcgggattgcttaccggttgccagctgggcttgcgtttttttgaccgcccgatgaagtttttgaatcgaggtgaccaagaccttaccgtcattttgttgcaatttacgcattaaatcaccggtattttgggcttcgttaatggcaatatcgtcattggcggcataggcactaaagttgctggttgtctgttcgtctaaatcccgccggtcaactaagaagatgaccttatcgacaccgggatcttgcgccgctaatttagcggttttatatgaggtgagtgttttaccagaacccgtggtatgccaaacaaagccatcttgatggtcatgaatccggtgcatcacggcttcaatcgcataaatctgataaggccgtaagagaattaagctctgacgttcttggtcgatgaccgtatattcactgaccattttgtgggccatgggaatattaaggacttggcgcgtaaacgctaagccgttttccacggggtgattatcccgcgttcgccaattgaacaaaaaggctttattgaaatgatccggttcggcattcgcaaaatacgccgtactatccggcgtcataatcacaaacatttgcagcagcgagtaaatccccgtatatttaccttcttgcgcgtatttttcaatttgattaaaagcctggttaagttcaaccgtggctttttttagttccaattgaattaagggtaacccattaatcaatagggttacgtcaaaccggcgatcaggatcgacatcttgagtaccagctaaccgtggtcgtactgcttgtcggaccacttcataactagatttaccaccagcgacgtccgctttccaaaacaattccagggtgacggtccccaatttggcatcatcacgttcgatttcaactttaccaatgccgttttcggcagctagtaatttagccgcttcgtaaggcgtccgtacttcaatagcacgtttaacttgattaaattcagtatcagttaatggctgcccttgcaatttagcataattattgttgtttaacttatctcgaaaattagcccataattgatcaggagtggcaccatatagatcttttcgctccacccattgattgttcccggttgttaaggttttaacgacttctttttcaaacgacagctccaacataaaaatagtccttccccgccaattttaatctattcactagtttagtatacgcgaagcaaatgaaagaatttgtaccagaaccaaattaatcactaatttcagtattacggattgataagaaaggatgtttataaatgtctatacgattaacgctatcacctgatatcaaggctaatggacgactatctcatcttcaaaacattgtggatcgtataaataatctgaacaagttttcacgggaaatggatgactatcatcatatggttaaacaaaacgttaactccataccagatgatttttcatttaatgaagtagctacagtggccttttttcaaacggtgtctgaccaagttaatactatttttcttttaacggcacatcatatatggaaagtaattttaggagagcaaataatagaggatagtctcagttatgtgcggctcatcgtcatagaatcccctaaatttaagacggaaggattgtttagtggcaaacagtttttgtcctttcaaccaaaagcaaatttaaaactatactttgactcgaaagaggacaaaagctttctggaaaccactttcacaaatgaaataaatcgttttttgaataaagaaagagttatgctagccaaacctgaaccaataccaatcagtgaaccgcaagaaagtacgaataaccatgcactggagaaccagaacaaagcgcttattgagacactaaacctagaaaataacgaaacagcaattgcactgataacgcttagtcagctcaaatatcctaaaaataagataaagccattgtcttccggggacattcccttgggtttccaatttatagaaaacgattatgtcacggaaagcggactagctattctcacaatgggtggagcctatgaaaaagcattgcaaaaagtaattaaggatattcgtaacttgattgagcaaaagaatgcagatggcgcctttaacttatgtcttactcatactgaggacgaaggctcatcgaccgtgtggatttatgcatattttgacattgcaaaaaggatcctttagtcagccccttcccttcagagtggagtttgtgcgagttgttcaactcaaaacaggccttccatttgcaaatgggttcatacgtcaatagtaggtgctatggctaatgatcagcttaagcaacttcataaagaccattgttttctccaggagaatggtattttaaaacgagcagtggtgttgaccagatgttgattcgtagtggccgaaaggccatttgttgttcaggtgcacctgtgccgcggacactgcgtgatgaccgttctgaaggcattatatgttcgcagcccctattatgaccgtgagatttcacccctagccctaggtattaacttatatattcttgccgatcattacataaaggaaatttattgtgagctttcaaaaattttcatccgcgcgttttaaaatcaagttagccacttttattacaaatttgggacaataaaaaacatcaagaacagatatcctgtatcattgaagttccaacacaaacaatgaaagaggtattgtcctgatgcatgaacaggatatcacacgtcgtcaaccaggtcatcatttgtctcaaatggaacgcggtagaattgcagaactttacgcccccggcacctccaaacgcgaaattgctgccaaaattggcgtctgccatcaaaccatcaataatgagattgaccgagggactgtcaagcaggctaagcgcattaatggcaaactgatctatcatacggaatatagtcctgaagctgctcagacgcgctatgagaccgcacgtctgaattgtcataggccggataaattcgccgctacaagccacttcctggcctggtatgctaatcaggccaagactgaacactggtcgcctgatgcagccgttggcgccgcacggcgagccaagctattcacccctgaggagatggtgtgcacaaccactttatatcgctacatcgatgatcaacgcttagaaattcggaacatcgatctcgtggagaaggcaaatcggcggaccaagcaacacaagagcactaagcataagcgcctagccggccgcagtattgaggagcgtcctaaggctgtcgaacgccgcaagcagttcggacattgggagatggataccgttgtcgggaaacgcaatggccgtgagagcgtcatccttagcctgattgagcggaagactcgttgccaacttctccgactgatcgacggccgagactcggactctgtggagtttgcgttacgagaaatcaagcttgagtggggtgactgtctgcgcacgattaccgcagacaatggcccggagttctcgactctgaataaggccttttaggacacagatacagacatcttctacgctcattcatacacctcatgcgatcgcggctccaacgaggcccacaatcgcatgattagacgtgactacccaaaaggcgagtcgctggatgatgttagtcccagccaggtgctggctacccaagaccgtcttaacgggcttccccggagaaagctagactaccgtagccccaggagtgttttgagaccgaagtgcgccggactcggcgttcagcacaacacgtaagctaaacaatgaaccactcataagataacaggctgttcttgggagtgtctcaacaccccggctaacttgttcttgcaatttgggataataaatcttcagcatttgcctcagtaacacgagtgatggtgatcgccatggcattgggcctccttaaatttgccttgagcttaccttgctgacgacggtattgcaagaccacgaattctttccttacattagctaaaacttcgactataattattttggaggcgattacatgtttttagatcatcgaaccattcgcaaattttccacgcaacaagttgacccgcaatgcttgaaccgcctgatcactgtggcccaacatactgcaacctcacatttcttgcagtcttttagcattattcatatcaccgattccgcactgcgttcacaaatcgccgccatcagccaccaaacttatgtcgatggcaatggcaatggtgaattattgattttcgtggcggatcaataccgcgcagacctatgcgccgaccaccctaaccaactcagctcaacggataaatttatccaagccgcatcggatactttattggcggcagaaaacctcgtcgatgccgctgaaaatcaagggttaggaaccgtgattttaggcagtatcctcaatgatccaaaacaattgatctccctgcttcacctaccgaacctcaccttcccgatttgtggcgtgattgtcggctatcccgatcaaaaaccaaacttcaagccgcgcatgccgcaaagcttaatgagcttcgacaatacttatcacttacctgacgactggaaaacgcaactaacagattacgaccacgtgattcagcattactatgcgacccgcgataccaatcagcgcgaagaaaccttctcccatttgttagctaacggtgccgcccatacgccgaaaaagcgcagcgaactactcgatgccttgcatcaacaagggttctgtttgaaataacaggataataaatcgattcatcttttaattttaatttgtgtcttgtcaagtgtcatgcgacaatcatctctaggcagctgcctccaaagggggtgttgtctttgttgaaggatctattcacagtcgttgtcggccctgtggtggtcggggttatcattgagttgatcaaacgttggctggacttgcgacaacttttgcgactgccgttgctgtttgaggatactaccgattgtgggttgcataggggaccttctttcataatgccaagtttatttgcttttagccactagggtataccctagtggccgtttttggcttagtgctatactggtgattataaatgttcattagaactgtccaaaaggaagtgctgacaatggctaaaataggttacgctcgcgtgagctctaaagagcagcatttagatcggcaattagttgccttaaaaggcgttgacaaactattcacggataaactaagtggagctaatactaatcggccagaactgcaaaaacttctggcttatattcgcgatggtgatattgtcatagtcactgaactagaccgtttaggcagaaataatcaggacctaactcagattatgaacaccattcaaaataaaggcgccaccctagatgtgttaaatttgcggtccatgtctgggattgctgatcagaacttacgtcaactgatgactaatctcattatagaactatataagtatcaggccgaaagtgagcgtaagcgaatcattgagcgtcagcaacaaggaattgctctggccaaacagaagggtaaatatcatgggcgaaagccccaatatgccgaagatgatccccgcttacaacatgcctttacgctttaccaagcgggcatgagtgatgtggacgtcgcccgtaatacgggtattaaaaggacaaccttcatcagatatcgaaaaaaattcaaggtttataattaaggcaggtatgttattcaagcgatgtgtggttaaaacaatggtatagatatcgcattgaaaaatttttctaagaaggcggccaatctatgggtaataatagtgataaaattaatttttgtgtgaactgtggagaaaggttaacaactcaatcgaatttttgcccaaaatgtgggaaaccaataaagcaaataaaaagtgtttcaaataatgcttcaggaatgcgattgacacaaagagggcccgcattaaatcaaaaggcggcagaacactcttccatttggcaaagtgctacgacagcattgaatcattacaccggagaaaccggtccggtcaatatcaatctcaagaatctattttctgaagtatttaagcgccattcccaaaatgaagctgaggaaatattcattgctggaactgtgacaacaacgcccacagtgtcagaggtctctgcagactgggggcgtccatggcttttttctcgaattttgatgttcttcggagcaatcttcatgttacttgtctacattgcagctgatatggataactctaatgccattccaggtgtgatcatgatcggagcctttacggtaccgtttagtgcattagtgtttttcttcgaaatgaatacatatcgtaatatcagtttttatgaagtcttaaaggtgttcttcttggggggtgccttatctttatttgtcacgctatttctatatcaatttgtatccttttcggttcaaaatcaagtttatggcatgatgacatggtcagacacgatttctgttgggatagttgaggaacttggaaagctgtttattgtgatctattttgtgcgccgcaagaactatcaatatattttgaacggtatcctcataggtgctgcagtgggaggtggctttgctgcttttgaaacagctggctatatttataattcgggtaatctattgcttcaaacggccttattacgtgctgcgattgcgataggtgggcatgtggtttgggctgcgattagcggcggtgcgcttgtgatggttaaaaaatctgaaagattcaattatcatcaattactcattcctaatttttgggtgtttcttggaagtgtaatcgttttacatgcgctttgggataaaggaatcgcgctgatgggaagtttgatgataacctatatcacgctcatagtagtagcgtggcttattgcatttgtcctgattaacgctggtttaaagcaggtctcaagaatcaaacaaggatgacttctcactcgcatactaacctcatctcgtaaaatctaatgtcattagagcaatcactatgggtagatctctataaatattcgaaacactgcccacaataatctcaagtagccgcagaaaattcatttgctaattataatcaaattgatattatgactgttaatcatcattttctttgatgtagtcatacgtgacttctccttcagatgcaatgtacaaatctaggttactatttaagggattcagcagaacaatattcacatccttcagtgatgtaggcattttaggcgatagttcagcagaaattttttctaaactgtttttaactgtttttaattcgctgggagaatcctgatcatcaagaatgtcaataagcttgtcatacagtgcggatccttcagacgcattgatggttaattgattagcttcttttgaatatgatacgtcgcatccactcatatgttcatctacaacagtagcaccaatatcagcaatttcttgttgggttaaattattacgtttgtattggatgtaagctgattcctgagacaacttttaagagagggtataatgaataaatcatctctcaaaaggaaggaatttttacatgccaacccgttacgacaaagaattcaaacaaaacattatcaacctatataagcaaggcgaatcagctgcccaactggccagagaatatggcattggctattcaacagttcataagtggatccagggccaggccaaaactcaatccggtaaatcgccagacgaaatcaaagtgatggaaaagcgactggcttcgctgtctgaggagaacgaaatcctaaaaaaagccctgggcttccttgcgcagaagtaaccaatatctttgattacattcaccaagaaagccatcaccaccaggtaaccaagatgtgccgaatcctcggtgtttccagagctcagtattatcgttatcgatcccccaaaccttcaaaacgccgggccgaagatgcgggcttgaaacaacggattctgcggatctttgcggaatttaagcagcgatacggtgttatgaagatccaccatgaattgaatctggaacttcaaccactgcagcttcggtgcagtccacgacggatttcccggctcatgaaggaactggatatccactccgttaccgtcaataagtggaaagcggcttcggcttccaaaaccaaggttgaacagcgtcccaacttgcttaagcaggatttctcgaccactggtttaaatcaaaaatggaccgctgatatgacctatattcaaacgaagcgtaatggctggtgttacttatcaaccatcatggacctccactcacgacggattatcggctattcgttctcaaaaaagatggatactgatttagtcttaaagacccttgaaagcgcggttaaaaatcgaaccattactggggacctgattatccatacggatttaggatcacagtataccagcgatgattacaatcaacgtttaactgagctacatatccgccactcatacagccgtaaggggtgtccgtatgataatgcgccaatggaatcctttcacgcttccctcaaaaaggaatgtgtttatccagtgccggtctttgaagattatgaaactgccgctgccgtcctttttgaatatgtgcatgctttctacaataggaagagaattcatagttcactgggctaccagacccccttacaagttgaaattgcaacacttacgagccaaatggccgcctgatttaatgctttccagggttcaaataagttattaatcgcgattaatgatttatttgagctgtggaaggtaaacgcggttctgaatgtctcttaaaatctgtctcaaatattgacttcaatccagcttcgtgcagcttacttttaagctccagaatttcttacttatacttctcctcttgcgttggctcgagcttcttgattggtttgatttgcttgtgcttacccataggcggccttcctttacgctgcgcacgtaaaccggtaactccttggtcctttacgatacgaatccaagagttgacttggctgggagagataccgaaatgcgcggcagctcgaactctgcttacttgatgtgtatgcacatactctaccacagtaattttaaaggtctgcgaatacgtagtcttgttgtgtttgaccttcaaagactcgataccgtgggtcctagcttgattgacccaggttcgaatattagcgcgcgaaggaataccatatcgaacgctgagctctctgtaaccaataccgcctttcaagtattcagaaaccacttttgcctttaattcgttactatatttggtcacaggaaatgccccacaatcgttagacttcttgtctaacaattgtagggcacttcaaatcggctgatcgaggactttttggtattcgtccagcacgtcattcggcaagggcgtcagtaaatgcaggtcatcgatgacatcgctggccgtgtcggtgctgggcaaatcaacgaaaaggtcgattttactgagacaatcacttagtagatcggtcagctgcgaaagcgacttgccgttttcatcggtgatcacgacctggcgatgattgaggggctggtgctcgatctgaatcattttcagcgcatgataaacattcaactggctcacctcgatatggttaccccgattgtaggcaatctggcccgaaaaaacaatctttaatcatgctctggcgcggcctggcgctctggggctaccggcgggcgatgccaacgcagccacagttctttgattccagacaaaatgagggtcggtagcgccgggatgaagactaccgcagcatacagcgtgctagaaagtggcgcggtccccatcacttcgttgaagaacggcatgatggtgacaagtaatgaagccaccgccgcgaaagccactgccagcagcaactgatggttttcaaacgggttgcgggcgaacaaagtgcgggtgctacgcgcgtcgaacacatgccacagctggccaaacaccagggtcaaaaaggcgagggtttgcgcttctgcgccgctcatgccttgactggcagcccagatgaaggcgacatacacgagcccacccatcacaataccgcgcaggaagatgcgcccgagcatgccatgcaaaatggattgtttcacattgcgcggcggctggttcatgaggtcggcttctggcacatcatagccgagggcaaagctcggtaaagcatcggaaatcatgttcacccacagcaccatcagcgccgttaatgttggggtggtggccgccacttggccgacgggttgcgtcatcagtagcacgccgaacagcagcgccaacacctcggcgacattggtggttaactcatgccgcataaagtttttgatattgccaaaaatggtgcggccggcgcggacactgcgctcgatggtggtgaatttatcatccagtaaaatcagatctgcggcgtctttggtgacttcggtgccattaatgcccatggcaatgccaatgtcagcagcgcgtaaggctggcgcgtcattgatgccatcaccagtcatggccacggtttcgccatgccgctgcaaggcgcgcacgatgcgctgcttgtgttccggcgacacccgggcgtatacgcggatgcttggcgcgagccggaacaaatcttcatcggtcatggcttccagctgcttgccttccactacccgggcgctagggtcggtgacaatgcccagctttaaggcaatcgcgcgggcggtgactgcgtgatcgccggtgatcatcacgacctgaataccggcttggtgcaaggtggtcacactttggcgcacttccggccgcggcgggtcaatgatgccggcaatgcctagtaaggtcaggtgctgctcaagctcagcggtgctaccatgcaacgccaggtcctcgtcgatgtcacgcagcgtcaccgccagcgtccgcagcgcctgttcggcaaagcggttgacctgcgcttctaccgcagtttgaccagctggcaatgttacgagttggtcgtggtccagaatggcatcagttttggctaaaatcacgtctggcgcacctttagtcagcacctgatactggtcgccatctttaatgacgacactcatcattttacggtcgctgtcaaacggcagttcgcgaatgatgtcgatgtccagcgcctggtctttgctcaaaatcgtatcgcgatcgataccaaatttgtggcccatcactaccagcgctacgtcggtggggttgccatacgggcggctgcggccttcgtcgtcggtttgaatcgccgcttcgttattcaggacagcggccatcatgaagcgcgaaaatccgggggtgtcggcttcgtcatcagggatgatttcgcctactggttcatagccgtcgccttccaccacataactggcgccattggcataaaaccgggtgacagtcatttcatttttggtcaaggtaccagttttatctgaggcaatgtagctggtggcccctagggtttccacactgttcagggacttgatcagaccgttgtttttggccagcatcgtggccccaatcgtgagcacaattgacagcaccgccggtagcgcatcgggaatcgcggccaccgccaaggcaatcgccgtagagagggattcggccagcgcagcgaaggagagactgccagtttgctgataggctttcaagagctccaccagcaacgtgaacgccacaatcaccatcgccaccatcatcagtttggtggtcaggcgcgcaatggtgcgttcaatcggggtctttttgtccttgacttgatccagcaaggtggcgattttgcccagctcggtttgcatgccggtcgcaaccaccaccccgaggccgttaccatgcgtcactgtcgcaccagaaaagcccatgttggtgcggtcaccgatttgcacgtcagcgcccaatgcgtgggtttgtttttgcacaggttccgcttcgccggtgaggtgggcttcgttggtttgcagctcggcgacatggagccagcgaacgtcggcttcgatgaagtcgccggttttgacactgacaatatcgccaggcaccagctcggtggctggcaccgtcagccagtcgccatcgcgcaggaccttggcgtggtgatccgccattaccttcagggcgtccagggatttttgtgcgcttttggcttgccagaaggagaggccggcattaacgaaaatcagcagcagaatcgcaatgctttcatacactgccgccataccatggctggggtcgtggcgcacgaagaagtcatagccggcgctggcccaggccaatagcacggcgatgaataaaataatcaccaagggttctttcaaggtggccaaaaactggcgccaggctggtaggggcttgctggcggccaaggcgttggggccatgctgggtgagccgggcctgtgcttcttcactggtgaggccgctttgccggctggtggccaagcgctttaggacatctgctttgtgttcgttgtaaggggtcataagtttcctccaataagaaaaggccgcacccaagaatcgctttcctccccgagaaagctttcttgagcaccgcccaaccgaattttttgaattagttaccttttattactagtttaaaggatacctaatgttgctgtcaaaagatttggcccgggccgccggtggcgtgggcggtgggctccgcttggggcgcgcggcctgctgtgcggccggtccgagccacagtacggtctcgggcctaattttagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatctttatgacgcattcaatgccatcctttactcgcttactacagggtgtcaatggcgtgaattaccgcaagatttcccggaatggcacactgtctaccgctattacgatatgtggcgagataaaccagacccgacagctgattcgctattagaaaggcttttaaaaaaactgttgcttcctatcgctttgcacagggccgatcggcccgaacgtcgtttgtgattgttgatgctcaaagtgttaaaaccactgatttaacgaaaaatagtggctacgatggcggcaaaaagatttcagggattaagcgtcatatggcggttgatattaacggtttaccacaagccattctcgtgacacgagctaatgtatcagatcgctcaggtgcattgactatgcgtagtttggctagccaaaatttagagctggttcagcatggcatggttgatggtggctacactggcaatgactttgcggatcaggtgaagctcattttgaatgctaagacgacggtagctaaacgcaacgagttgcatacgttcacggtgttacagcaacgatggatcattgaacgttcatggagttggctagacaaatgtcggcgactttggaaaaactgtgaacgcgcccttaacagcagtcttcaaatggttgtattggccttcctgaagatagttcttaaaagatactagacgggttctaaggactcataaaaattcctcttgatctcatcaggttcattgacagaaacttcaaacaattcttgaatatcaatttgccaaggatcagcaagcatttcatcaatgggctttaatactttcttttcgtctatctgagttactcctaacattagctaattatttcaggtttaaactaaaggcatctttttatagttagttattcaaagattgtgattaagtttagaaagaaaaacggtgtaaagcaattaaaaagatttgtttgagcgcagcgaaatctaatacaatttttgggatatcgaaacacgtcaaagttagttgacgtgtaagtgcacattgaactaaaaaaaccttttattttaatgatcaagttagctattttttagcgtcattaaacggaatgaaatgagtttaatgcgcacttatactccactaaaaattagtggaggttttgtgcttaaaatctgtctcagaagttgccttcggcaacaactaaaaatccaaataaaactaaccaaaatcaatttgatctaacatagtttcggtactggcttggtctaagcctaaataagctaaagtcatggcttcacttgaatgatttaataagtgcatgactaagccaatattgtaattggattgcgtataaacgcgataagccccagttttgcgcatagtgtgggtaccaaggtaattaatgcttaaaagatcgccgactttgctcatgattttatagaactgtttttccgtaatatggcgctcggggtgttgaatggaaggaaagagccattcagaatccagcttatgatcaagcagccattgacggtacaataagagctctgtttgaactggtttaaggtacaaggtattcggtttaccagtttttcggtcatgaataaacgcattttgtttaatagaaccgtccggattaaaaatatcggtttgttttaagcgcatgacatcactgactcgcaacagtgtcgctttgccaacttgaaaaactgtatagttacgccggccagctttaaagttgttgagtaaggtatcttgcacctctttgagaacgtttgaatctttgatgggtaagacaacttgttgcatagttttagctccttaaaaaattgatttttagtacaagttaaagtacaatattaagtacaatgaaagggtggtaaatatgacattagcactaacacagagcgattttcgcgctaacctaaaaaaatatttagatcaagttaatgacgaagacgaaaccgtttatattgctcgttcaaatagtcgcgcagtagccatcgtttcacaagaaaaaatggactggttagaaagagcattaaaagctaaagaaggttcgttagaatatgcaattgcacgtgatcagttaattaaacgccatgttttacctgacgatgaaattgttgaatcagatgatgattattggggtcagtttaaataatgaaaaaactaagatttaaaccacgtgcaacctttaatgctgatctaaaacggttagccagtttagacaaatctattattgatgaagttcgagcagccattgacctgttgcttgagcaacaacaattaccaccagaatttgaagatcatgagcttaatcggcgaatgagcggttataatgaatttcacttacgagataccccgaaaaacaaaacaccaagcgaaactaacgatgtcctggtggtttatacgattgataaagatgaactagtcttaattggcattcgagtcggatcgcatgatcgtttatttcctggtcaaaatcgtgctaaaaggtatcgaaaaaatgacgaatataagaagtcatttttataatatgaaaataaataacccccaacatctatattatagatgttgggggttattctttcaaagtttttgaggggttatttgttaattatagaccctatatattcatagcccctttctgtttggtgttaaagtattagtcatcgatgtcatgcactatcttgtttagctccgttttgatggaaatgggaatattttctaaattgaaatgattatatatttctttatccttaagcatccttttttgtgccttatttaatttagtggctgttgaactaggccgccatatcttcgacccttgtagtaaatttatagcgaatttgataggcctcaccctcgaatttagccaaaattaaaattggtatagcaaatacccttaacagggtcagcacattgctcaagacgatggccgcgtcaatcttgacggccagtgattcagctgtccgagtgttcaccaagtcaagccccagcgtgcccttcataaaagcaaaccggcgttcaatggtacctcttcgattctcggcatcagtatcctcacgccgtttcgctgcatcaacgtgttttggatgccggccaagcttcggaccgcagattcggatacccaaatccttacacagctttaggttctcccgattacggtacagcgtatcggccagtacttcatccggataatgtccatgaaggtcgtaatagtggtctaaagtttccgcgaagtcttggccctcagagaatgcggtgaaatcaaaacgttcaatgtcgactacgccttcacttaacgaacagtcaatcttcgccccaaattcaactttagcattggccttaccacgttgaattgggcgaatgtacggctgttggagactaacaattcggtcttcaacgtggtgagtcttgtgggtatacatgtaccattgctggtcaaatagaattcgaatcacgcctaagcgaatcgcttgttcatctggtagagtcgcaccctgatcgatgaattcgttgatgtaccgcaaatcacggcgcacatattgaagttgggccttgacctgtttatgaaagccaccacgctgttgctttggatgtcgtgaaaatgaggtccaacaatgcttcgcctcgcgtttgtacatgcgtgggtttggcacaccaagttggtgtgccatatcgatcgccatcgcctcaagattcagccttgcttggttgaggaggacggtgtcttgaggatacttgattttgactggcactgcggttgcgtccgtgatgacggtgtccactttgaatgggaccaacgcttcgatcttggcgcgtactgtatcattcatgatattcgtaatcagctcggagatatcggcaattcgtttgcgaaagtgtgccaggctggaataattgaacggctcaaccgctttgtattcggacaacccgatgaaatattgaagtgcgggtgtatcacgaattgccgcaaccaccccacgatcagttaaacccatccgttgttggatcaggattgccccatagagtaaacgaaatggttttgccgcacgtcccgcatttttggtgaactccaattggtatgcctcatcgagagctttccagggcatgacctccgccaactggatccactcattgttagagctaagtggggtacttaaaccggcaccaaaggattcaaatgacaattgaagcgggctgtgacgatagaccatacgataacctccgagtaggttcccaaaaaatgcaaggaaaatgcaggaaaacagctaattccaatggatttattataccgcaataatgcatatattagcttaactgcctgaattatagaatttttaagcagccactaatttacactcattgttacccactacccattcatcctttgtacgtataaaggggttttgcgcactttcctttaacgcgttttgaacatcttcataaggtaaataaaattcaattgtagatttatttaattttacaatctaccatataacgtctccatcttttcaaaacgacttaattctacgggctataaataacttaatttgccagtctataacgtttcagattaagctaccactatgttataatgaccatatcgaaaggagatcaatctaatgaaatatacgaaaaccaaagcagtattaaatcaactcgttgccgatttgagccagatgtcaatgattatccatcagacgcattggtacatgcgtggacccaactttttgaagttgcaccccttgatggatgagttcatggaagaaattgacagccaactcgatgtcatttctgaacggctgattgcgcttgatggcagtccttactcgaccttaaaagaaatggccgaaaacactaagattcaagactggcctggtgaatgggacaaaacaaccccagaacgcctcgcacacttagttgatggctatcgttacttggaagacctttaccaacacggcattgaagtatccgatgttgaaaaagacttcagtacccaagatattttcattggtctcaaaaccgcaattgagaagaaaatctggatgattcaggcagagcttgggtcggcgccggaaattgatgaataaaataatattaaaaaatcggtaggcttaaacattgctaacgcttatatcagtgctgctatttaattaaaatgcgacatcccaacaacggggtggcgcatttttgtttacaatgcggtgacaaatgggccggaaacaaaataagtgagtgataactcattttaatgttgacaaaccgagatgtactgattatactaaagccattaagtgagtgagtatacactcactttgagaaagagggttcttaaaatggcaacggattatgtcatcgccaagcaggtcagcaagcactttggtcatcagcaagtgctcaatcagattgatttgacactgccggctggaatgatttatggcttgattgggccatcaggagctgggaagaccaccttgatcaagagtattttagggatggaagctgtggatagtggcactgttaaagtcatggatacggtgatgcccaatagggcggtaatggcacaagtagggtatatggcccaaagtgacgctttgtatgagacactaacggcccgtgaaaacctgaccttgtttgggcaattgatgagcgttccaaaaataaagttagcacagatgattgattatgcagccggattagttgatttaacgtcccaattagacaagcgggtcagtggctattcgggtgggatgaaacggcgcttgtcgttggcaattgccctgattcaggatccccaattattgattttagatgaaccgaccgttgggattgatccagaattacggcaacaaatttggaccgaactaaataagatcaaggataccggtaagtcgatgctcgtgacaacgcatgtcatggacgaagcagaacggtgtgattatctcatgttgattcggcacgggattgcgcttgctgaggggacacccgcggcactgaaacaacagtatgcagtagatacgatcgaacaggtctttttgaaagcggggcggatgcaagatgcgaacgatggcaatcgttagacgagtttttaagcaaatgttacgtgataagcgtaccttggcgctgatgtttttggcaccattgctgattatgacgctgatgtatttcttatttcaaaacaacacgacgcaagtagcaagcttgggtgttcatcatgtagaccaatccgtggttaacgtgatcgataccaaaaacgtgacgattcatcattatgatagttcacaggcacggaaaatgattaagcagcatgatctagatggctatttgactcagaaaaatggtcaattgacgattacttattcaaatagcaatccaaccaacacgtctttaattaaggcgagtttacaatcaggattagtcaagttgaaaatgaagacgctggtgaccgttactaagaaacagcgcgcggcccttgaatcgcaacaagccgctttgaagaagctgacagcagcccagacacaagcaacggtgaccaagctgaagactgccattgcacaagcccaggcccgcggtgaccaggcaactgctgagaaattacaaaagcaactcaagcaggccacagccacgacgtctagttcgactcagtcagctaaagcaaccagttatacgactaagtctcattatatttatagtagtagtgattcaacgttctttgaaaacttttttccagcctttctcggtttctttgtcttcttctttgtgttcttgatttctggcgtttcacttttgaatgaacgcactactggaaccctaagccggctacttgcaaccccaattcgacggagtgaaattattatgggctatctaattggttatgggggctttgccatcattcagactgtcctgaccgttgttttcacaattacggtcttcaagattcacttagttggtagtatttggctggtctttctgactaacttattattagcgttagtggctttgaccttgggtatctttatttccacctttgctaactcagaatttcaaatgattcagtttattccactgattgttgtaccacaaatcttttttgctgggttggttccagtcgatggcatggccagttggttgcaagcaattgcccacatcatgccgttatactatggtgctaatgcgatgacggctgttgtgacaaagggtgctgggcttggcgatattggtgtcaatttgttaatattagtagggtttatggtcgtactaacaatgttgaatattgttggaatgaaacgttatcggaaggtgtgaggatatggaacgaccacggatacgggattattttcaacaggatctaagtcagaatgaaacgattacacctaagcaacgggccatcctccaggcaagtctcgatttgtttgctgaaaagggttttgaccagaccagtactagtgatattgcacaacgggccggcgttgcggaggggacggtctatcggcggtataagactaaggctgccttacgggatgccatcttagcaccaattaccgcgcacattgtgccaatcttagcgagtgatttttcagaggatgaattacggcagcgttatcccagtctacaggcattcgtcacagcaatttttacggaccgagttgcatttgctaaagctaacgtgaaagagttaaaggtcatttttgaaatggcagcttttgacaccgaacgacgcgaacagattcttagccagattgcgcctaagatggtcaagcagatgggaagtgtcataaatcaactaaaagtagatcatttgattgtggattggccgaatgatttgatactgcaaagtttgttatcgcagctatttggttacctagcgcggttaatgctggaattgccgggaactgaaattgagcgcgaacaagcgtatttgattacggtgatgaccaaaatattgaccccaggtgaacatgatcaaattactggtcagtgagctaactgttacttgatataaactaaagccacttctgtacttagcggtcatttgaacgctaagtacagaagtggctttggtcgttgctacgcgtgttcgtttgttaatctgctagtatcgtcattttattcaacaaactagtttgtaactggctgagtgtggtcgtcatgtagaccgggtaaagatctgggttgacgagccgctgggttgttcgtgggagctcggcaagtttagcctgggtcgttgcctgaatggttgtaaccggaattgacgtggtgttggacaaatctaccggcgcgagtaagggccggacttcaaaatgggtgagtcgctgttgacggtcgacactgagtgggtcactgttgacaacggttaggctggtcgcatcaacgatcgtctcggtagctagtgcaatcaaatcagcaaaggcccgctgagttcctggttcgtacaaacgatagacttgcttatcaccaggaatcgttagtttttcgcgactggcactgaccttgatcttgggggtgctctgaccattgctctcagttgccgcaagcttgtagacgccacttagaaccggtgcggacgcgctagtgatgagcttttcaccgataccaaaattatcgatcggtgcgccttcgtgcaacagcgaggtaatgatgtgttcatccaatgcgttagaaatagtgattttggcattgggaaagccagccgcgtccaattgtgtccgggcagcttgtgataaagtcgtgacgtcccccgaatcgattcgaataccgacgggttcatgcccagctgctcgtagctccttaaagaccgtcaccgcgttagggatcccagagttagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatcttcatgacgtattcaatgccatcctttactcgcttactacagggtgtcaatggcgtgaattaccgcacgatttcccggaatggcacactgtctaccgctattacgatatgtggcgagataaaccagacccgacagctgattcgctattagaaaggcttttaaaaaaactgtcgcttcctatcgttttgcacagggccgatcggcccgaacgtcgtttgtgattgttgatgctcaaagtgttaaaaccactgatttaacgaaaaatagtggctacgatggcggcaaaaagatttcagggattaagcgtccccagtttacaattcaagtgcaacaccctgacgactagaccaaaaaggccatgaagacctattcttgttagtgctagctaaacaagaaagcaggaatcttcatgacccactctcagactaacacccacaagcattaccaacaactcagttttagcgaccgtgctacaattcaggcccttcaggctgctggtgacaccgcgaccgtgattgcacagaagcttcatcgcagtaaagcgacaatctcacgagaaatcacgcgtggatctgtaactcagctcgactcgaagcgtcactcgcatcaagtctatcttgcggaaactgcccaagccatgcacgaccgtaaacgcgatagaaccggtcactacgcctttcttaagaccggccgtgcgttcttcaaggctctcgccagggagcttactcgtaagccgcgcgtacacagcgttgataggcttcgtacacttctatcgcgaccagggcaaggcttgcccttcaacgacaactgtgtatcgctacatcgacgccgggctgcttgatctagacaacatgacacttcccaagaagctccgacgccgcatcaaaggctataagaacgcccacaagcgcaagaataagaagatatacggcgactcaatcgagttgcgtcctgcggccgtgaatgaccgcacaggcgtgggacattgggaaggcgacttggtcaaaggtattcgcttagctgatgagccagcattaatgacgctcacagaacggtacagccggactgagatcatcgtcaagattcctgactatcatgcggacacctgccttaaagccttgcaggacacgatcgacgactacggggccaaggaatttgagagtatcacttttgacaatggttccgagtttgccaagttatcagagattgttggaacccagatttacttcgcacatccgtactcgccttgggagcgtggcacaaacgagaacgccaatggactgcttagggaattcttcccgaaagggaagtctctcagagcagttaccctggttgaaattcaagcagtccaatccgcactgaaccatcgtcccagacgtattctgaactatcttcgcccatgcgattactaccgatgcatggcgtaacagcctagaccactatcaagaattcgttatcatcgttgcacttgacttgaaaattgagggatattaaaaaagttccgaagcaaaattgcttcggaacttttttcgtgtatctattgaggattaatcttcgtcgtcttcctcatccaagccttctcgtggtgtcttaccaagcaaggcctgcagagtagcgatgttgtggttgttatcttgcagcaggccaaccaaatgttgtgccaagactggacggtcttctttttcagccagcttaattgcccgggtgacaaacatgttctcagtgtcatagtcgtggacgaagtcgttgaccagccactctacagattcatatttgttctggccgttttcttccagcatggtgtactctgtgaattccttttgggtacttggcgtaattaaggcctcatcgattaagaccgtgcccaaggcatccttttggtcgtacgcctgcttaagtaagtcgccgaataggactttcagctgttgggccgacattcccttcacataccattttgccatctggagtttgttggataaaacttccaaattggcaacgatgtggccggtcatcgcaccagccgttggggtatggtggtcgatatctgcttgcttaacttctgcttcaaataatttttcgggggttgctgttgtcatattcttcacctatttcactttcattgattgaacttcatagcctaaatcagttaccgtgtctgacaatttgtctgcggaaattttatcgccgtcaaaatcagttttgactttggctgcattgaacaagactttgacgttttccacaccatcctgcttttcaagtgcgcccttgatcttttgcatgcatgacgggcatgacagcgcgtctaattgtaaaattgctttactcatattgataacctccatctcatttactgttttaatgataaatcctattcgccaaccgataattgatctggatcaagtttggcagcttttggctgataattaattaatcgcattgcgttgaagatgacaaccaggatactggcttcatggacaaacattccgctggccatgtaaataaatccgagaatcaagccaatcaggagggcgacaaccgtcgcaatggcgatgaaaatgttctccttggtgttgatgaccgtttttttggaaagtccatatgcatggatcaattcattgaatcctgatgacatcaagacgacatcagaggtttcaaccgccacgtcggttccacttcccatggcaatcccgatgtcagccgtcactaatgacggactgtcgttgatgccgtcgccgacaaaggcaaccttgtggccttcctgctggaattgtttaacgtattcgactttttgttccggcaaaagttctgcgtggacttcgtcaataccgatttgttctgcaacggcattggctgtctgcaggttatcaccggtcagcataaccgtcttcttgatgccgagtgacttgagtgtcgccaggctttgcttaacgccttgacgaatcacatccgagataccaagaatggcttgaatttgcccgtcgaaggcaacgataactgttgaactgccttcgccttggatgttttccaagtcttgacgttgttcagacgtcaaatcaacattttcatcgttcatcattctcaaattaccaattaaaacatttttaccgttggcagttgccttaacgccacggcctttgactgtgtcagcatcggcaacttgaacgtcctcaaacggaatatgatgatcacctgagaatttaacaactgcttgtgccaatggatgatccgactgcttttcaacggctgtggcaatttgcaaggccaactggtctcttgagtaatctttcaactgagtaaccgccgttttcccttcagtcagggtcccggtcttatcgaataccaacgtgtcgacattggcaaaggtgttcatcacttcaccgcccttgatcaagacaccgtttttcgcaccattaccgattccagccacgtttgaaaccggggcgccgatgaccaaggccccagggcaacccagaaccaagacggtaatcgctaatcggaaatctttggtaatcaaacccacaatcagtgcaatgatcaaaactgccggagtgtaataagtcgcaaatttgtcaataaacttttctgctggcgacttggtgtcttgagcatcctcaaccagttcaacaattttgccaaacgtggtgtcgtcgccaaccttggttgcccgaactttaagtgttccgttgtctaggatggtgccagagaatacctgatcgccagtgcccttagtgactaattttgattcaccagtaatactggcttcgttgatatgaccgaatccatccacaatttcaccgtcaaccggaatctgaccgccggctttgaccaagacgacgtcgtcaacgtcgacaaagtcaacatcagtctcctcagtattgccgtcatcgtccacaaccatcgccgttgtcggtgccatttccgtcaagtttttaattgagtggcgggttttagccaacgttttgtcttccaaaaacgttccaaataagaacaagaaagtgacgattgctgattcattgtactcaccaatgatgaaagcgccaatcacagcaatactgacaagtaattcgatgctgatcgttttaaatcggagtgcggaaactgcccgaagaacgatcggcacagctgagataattgaagcggcgatgaatgaaaccgtgtagaccatatcgctgtcaacaactttccccagcaagcctacgccaatcagtattgccgttatcaatgtaatttgatttgtgtgttgattaatatatctttgaaatttcataatccccgatccatttcttaattgatgtctttagtatatggtggttcgaccgataaagaattgacgtggatcaagtttgaaatttttgtttgggtaattaatggcgaatattttcttggatttttgggtggttcgcgataatggcgtttccagagagcatatggatcgttaaattttcagcgatcgaactcttcttagaagctgtctaaaatctcttaagtagtggctggtgaattaggcaacattccggctacctgaaacgtgaatttgatagtgaattaagatggattcctgcttatattttacaaaaatcaaaattggtccattaaaaagccttaatagcatctttaggttggctagattgatcgcaatatcaatcgtcactgcgatgctggctaccgttttagtccgcaccaatgaaaggcccaaagggcctttcatgaaggcaaaaccgcgttcaattttcccgcgccgcttctctgcgtcacgatcaacttgccgctgcttagcatccatctttttaggcttacgtcctaagaacctgtctagtatcttttaagaactatcttcaggaaggccaatacaaccatttgaagactgctgttaagggcacgttcacagtttttccaaagtcgccgacatttgtctagccaactccatgaacgttcaacgatccatcgttgcggtaacaccgtgaacatatgcaactcgttgcgtttagctaccgtcgtcttagcattcaaaatgagcttcacctgatccgcaaagtcattgccagtgtagccaccatcaaccatgacatgctgaaccagctctaaattttggctagccaaactaaacatagccaatgcacctgaacgatctgatacattagctcgtgccacgagaatggcttgtggtaaaccattaatatcaaccgccatatgacgcttaatccctgaaatctttttgccgccatcgtagccactatttttcgttaaatcagtggttttaacactttgagcatcaacaatcacaaacgacgttcgggccgatcggccctgtgcaaagcgataggaagcgacagtttttttaaaagcctttctaatagcgaatcagctgtcgggtctggtttatctcgccacatatcgtaatagcggtagacagtgtgccattccgggaaatcgtgcggtaattcacgccattgacaccctgtagtaagcgagtaaaggatggcattgaatacgtcataaagatcataacgacgcggtcttgtatgcttgcggaagttttctaaatcaggttgtattaacgcaaattgcgctcgagaaatattgcttggataatctggcatgacaaactcctcagtcggttttccacaattctaccagattcagcagatactagacaggttctcagaggcatttcaccatactaacaagaaaaccaaaaattcccagatcattaatttaacatatcgtatcaaaccacgcctggaatattatctaggcgtttttttagtgtcatggtattttctggcagaaaggttgcattattgtgactacagttgtaaactaataagtgttaagagactacaaatgtaaacttagaattcaattaatggaggaagccaattgaaggatgcaaagaatgtaaccatcaccgattctgaatggatggttatgagagcaatttggacaatgggacatgcgactagtcgtgaactaatcgatgctatgaacgaattagaaggctggtcagcttcaacaaccaaaacgctacttcacaggttgattcaaaaacaggcggttgcgcagcatgccggcagtcgaccattcacgtataagccggttgttggcgagaaggaatcaatggcggcagcggcagatgatttgtttgaccatatgtgtgcgatgcgggctggttcaacaattgccggcgttattcagtcaagggaactctcacgggcggatattgcgaacttacaggcgattctagctgaaaaggccaaaacagcgcccgaggaagttcagtgtaactgcttgccgggtgatcaaacgtgttaagactgtggtgttctgtttacttttaggattgctgcacaaaaatccagaatctgggatttctgatggcggaaacttatgaatttttgtcgtaattctcattcatatagtggcatggtgctccgcaaagcagaagcctaaatataagaacctggtggaaaaatcccgagcccggggatttccacacaaggaacttatattccggattctaaccgctttgctacgcacacttatttttagggggtcgataatcatggcaaataaagaggaccatatgaacatgaaaaacatgagtgctaagaatatggaaaataatgaatcaaatatgagtcatatggatcatgatgacatgaaaatggatcacgatatgaccgaaacggatcataatcaaatgaacatggaccacgatatggccgaaatggatcatggtcaaatgaacatggatcacagccaaatgaacatgaatcacgaaactatgaatatgagtgggatgaatcacggtgatatggatatggctgggaccgacatgatgatgcacggtggctcaatgatgcatatgggaaatttgaaagttaaattttgggtctccgttgtcttagcgattccagttttactgttagcaccaatcatgggtttaaacgtttccatccttagtttcagttcaccgctaattgttggcattatcatcgttttgtttgatacagcactttacttttatggcggaatgccatttttaaagggggctaaagcggaaattcaggataaatctcctgaaatgatgacgctagtaacccttggaatttccgtttcgtatttctacagtttgtacgcatttattgccaacaacttcttgaacccggcaaatcatgtaatggatttttcgttcgaacttgcaaccctgattttaattatgcttctaggacactggattgaaatgaatgcattgatgggggctggggaagccttacaaaagatggcggccctgttgcctaagacggcccatctagttacagataatggtgaaacaaaagaagtgccagtatctgatttaaaagttggtcaagctttccaagtgcgttcaggtgagagtattccagccgatggtgttattacggctggggagtcgaccgtgaatgaagcactggtaaccggtgaatctgctgccgttaccaagaacgttggcgataaggtcattggtggtgcaaccaacaataacgggacgctaacggttaaaattagtggtactggtgactccggctatctttctcaagtaatgaaaatggttcaaaatgcccagcaagctaaatctaaagcagaagataaagctgatttagttgccaagtatctattttacgcggcatttggtgttgggattattgctttctttgcctggttaccccagggattggcgactgcaatgacgatcatggtgaccgtcttcgtgattgcttgcccgcatgcattaggattagcgattccattagtggtttctcgttctactacgattggcgctcaaaatgggctattagttcgaaatcgccaagccattgaagcaagtcaacatgttagccacgttctcttggataaaactggcacgttaacagaaggtaaatttacggtgaatgcattgattccaaatgatgggattgacgaaacaacgttattaagccgactggccgcccttgaaaataattcgactcatccgctggcccaagcaatcattactgaagcccaagcgaaggacattgaagtcgttgcggctgaaaagtctcaaaatattccgggcgttggtatttccggtaatgttgatggcactgactatacgattgttaatggtaactatttaacgaagcaagggatcaggtttgacgaggccgctgctgataaatgggctgctaagggtaattccgtcagcttcctattgcagggcacccaagttcaaggaatggttgctgaaggcgacaccatcaaagcgggtgctaaggaattaattagtggtcttcagaggcgaggaattacccccgtaatgctcactggcgataatccaaaagccgcggaacacgttgctaacttactaggattgacggaattccatgcaggcctattaccagatgataagcaaaagattattgctgattatcaagcaaagggcaatcacgtcatcatggttggtgacggcgtaaatgacgcaccaagtcttgccgcggccgatattggaattgcaattggcgccggaaccgatgttgccattgattccgctgatgttgtgttggttaaatcagaacccagcgatattttacattttcttgatttggctaaaatcacaaatcggaaaatggttcaaaatctctggtggggagcaggctacaatattgtcgcaattccactcgctgccggtgtgttgtcatttattggaatcattctagacccagccgttggtgctgcggtcatggcgatgtcgacaattatcgtggcaattaatgcgatgggattgactggtgaaaagattaaaaacgtgtaattaagtgatgacaaaaagaggagaaagatcagctggtagtctggtctttctcctctttatgatcatcatgttaattacttatctggttgctcagttaatttcgccaatttttgatgcagcctaatgtcatattgcctggtaattggcattaacaccgcgaccacccagcaaatggcagcaccgattcctgcaatcacaaataggcgttcaatgccaatcacatcagctaggggaccggcaaaaattaagccaattggtccagctagattcaacaaagaattaaaaacgcctagaatccgccctaactcttctgctggataactttgttgaatcattgccattaaaagcgttgtaaaaaatggggtcgcaattccttcaatgatgtttaaagctgcgaaccatgttcgggccgatcggccctatgcaaagcgataggaagcaacagtttttttaaaagcctttctaatagcgaatcagctgtcgggtctggtttatctcgccacatatcgtaatagcggtagacagtgtgccattccgggaaatcgtgcggtaattcacgccattgacaccctgtagtaagcgagtaaaggatggcattgaatacgtcataaagatcataacgacgcggtcttgtatgcttgcggaagttttctaaatcaggttgtattaacgcaaattgcgctcgagaaatattgcttggataatctggcatgacaaactcctcagtcggttttccacaattctaccagattcagcagatactagacaggttcttaggatttcgttctcctcagacagcgaagccagtcgcttttccatcgctttgatttcgtctggcgatttaccggattgagttttggcctggccctggatccacttatgaactgttgaatagccaatgccatattctctggccatttgggcagctgattcgccttgcttatataggttgataatgttttgtttgaattctttgtcgtaacgagttggcatgtaaaaattccttccttttgagagatgatttattcattataccctctcttaaaagttgtctcaggaatcagcttacatccagaatgagttctttataaatggatcttcacttcctatattatgtggcagatttagttatttaactataaatatgttaagcttacttatatatataaaaattacttggaggcataacatggctgatttgtggcggacaatttctgaacggcacggcgagttgcttagtgccttggggcaacatatcgaaatatctttaattgccttgatgattgccgttgtgattgcgattccattggccgtttgggtccagacgcatcacaaaaccgcggcagtgctgctgcaagtgactggtgttttgcaaaccattccttcgttggccttgttagggttgttgattccgtttgtgggtatcggtacgctgccagcgattattgctttagtggtgtatgctttattgccgatttttcaaaatacatatatcggtttacgcgatattgatccttcctatgaagaagcagccgatgcgtttggcatgagtcgattgcggaagttgttcaaagttgaattgcccatcgccttaccggttatcttgtcgggcgttcggactgcaatggtcatgattattggaaccgcgacgctggcagctttgatcggcgccggtggcttaggcacgttcattttgctaggtattgatcgaaatgatgcggcgttaactttaatgggtgctttggcagcagcgctattggcgattgtcttttcgtggctcttaaatgtcatgcaaaaagtgagttggaaggtcagcgtcggggttgtggcaattgctatctttggcatggttggcagccaagtatacacttatgtgaccgcaccaaaggaaactatcacgattgcgggaaaactaggcagtgagccggatattttgatcaatatgtacaaagaactcattcaaaaagctgatcctgatgtcggggtcacgttgaaatcgaactttggccagacgagcttcttgtacaatgcgttgagaaccgataagatcggcatataccctgagttttccgggacggttctggcaagtttgacgaaaccatctgccgctcagcaacaacaggtgacggctggtaaagataattatccacttgcaaagaaactgcttgctaaacaaggcctgagttatctcaaaccgatggcgtataacaacacctatgctttagtcgttaaggaaagttttgccaagcgttatgatctgcataccattagcgatcttggcaaaattgcaccatccattcgcgccggatttgatttagagttcattgaccggcaagacgggtataagggcatccaatcaaaatacggcttgcagtttaaggtggattcaatggatgcttccttgcgttaccaagctttagaccgcgggcagatcaatttgaccgatgggtatacgactgatgcgcaactgcggcaatatcatctggtggcgttgcaagatgataaggggttgtttccgatttatcgcggtgcaccattgatgcgaacggcctttgccgaaaaacacccgcaacttgtagctgcattgaacaagttggctggtcaaattacggaaaaacagatgcagaccatgaattatgccgtgagtgtgaagaacaaaaaggccgcaactgtggctcaccgctatttggttcagcatggcttgctgaaggaggtgcgctgatggcattgatcagtcttgaacacgtcacaaaggaatatgacagcaagcccgtggtcaacgatcttagtctgaaggtcgatcaaggggagttgtttgtgctagtcggcacctccggcagcggtaaaaccacgacgctgaaaatgatcaatcgtttggttgatccaacgagcggcgtcatcgaatttgccgacaaaccgctcaccagttacaaaatgcgcgacttgcggtgggatctggggtatgtcctgcagcagatcgccttgtttccaaccatgacagtggcgcaaaacattgccgtgatccccgaaatgaagggctggtcgcgccaaaaaattcggacggcaacagacgagttactcacaacagttgatttgccgccagccgagtatcgcaatcgcatgccaagcgaattatccggcgggcagcagcaacgcatcggtattttgcgggccttagcatcacggcctaaggtggtcttgatggacgaaccgttctcagcattagatccgatttcccgcactcagcttcaggatatgctgctgcatttgcatcgtgccttgaagaccactgtcatttttgtgacccacgatatggctgaagcgatgaaacttggtgatcggatcggcgtgatgcgcggtggcaaactcttgcaggttgatacgccggaagaaattgcgaccaatccggctaacgatttcgtggcggatttgttcaagggagcgcaagccaatcagggcctgcaggtcacgctcagtcagttagcaccatttgcagcggatgtgtcggcccggcatgcggttggcggcaacttgacgctggccgaggcgttgccgcttttagatgcgcatgaggcgttgcgcgtgaatagtgaacatggtgcgtttgtggtcaatacccatagtgttgtcgcttatctcgcaagtgcattcgtttcgtaaacgactaatatgaattcttaactgtgacaatcacttttcaagactaataattatgttgcacgaactgcatttagaaatgtgaaattaaacaactttactctccaattattgtctccttagaaaaaagtctactgtacattttgtgaacgcacgttatgctacactgactcaaaacaattcaaataaaatggagctattccttctcaatccaaaaataaggagttaaacaatgtatctagcattaaaagaaattcggcatgaaaaactacggtacggtttgattataggcatgattttactagtgacctaccttgtatttattctcggtgcattagccaatggacttgcccagcaaaatacacaagcaatcaattcttggaacacagcccaagtggtattaacaaaagattcggacactaatttaaatcaatcactattgactttgaaacagacaaagccaatcaacctgaataactcgcaagcttatgttggcacaattggtgcggttgctactagcaaaaaacgtccagacattcgctctacggtagtcggacttgattggaatcagtatattggtaaaaacatgctaatggctagtggtcaccgcgtacaaagtgataagcaaattgtcgtggataatcaatttgaaaatgaaggttataaactaggtgatagagtaaatttaacatcaaatggtcagcagtacactattgtaggttttacaaaaaatgctaagttaagtgtttctcccgttgtttacagcacgttggcaacatggcgaaaattacgtaatctaccgagtaatttcgtagcaagcggaattgtttcaaaaaccgccgattttaaaatcaatactagtgggctaagaacctatactaaggaagcctttattcaaaagcttcccggatattctgctcaaattagcactttttcattcatgattggctttttattcgttatttcaataattgtcattgcggttttcctttatattttaactattcaaaaaattcccaattatgcagttttgcgagctcagggtgtgcccgttaaagttttggttaaaacaacaattgatcaggcacttattcttgtaactgttgggttaattcttggcggacttatggcatcaatcacagcgaaggtaattcctctaggagttcctctaatattctctactaatttagtcactacagctattctgggcatcttagccactggactacttggagcaattattccaattcgtactattcttaaggtaaatccagtcacggctataggaggctagtagtatgaatgctattgaattgcaacacattgtaaaaaaatttaaaacacctaccagcaacgttgaggttctaaaaaatgttaatttcagtgccaaaactggtagtctttcactagtattaggtccatctggatctgggaaaagcacattcctaaccattgcgggtggaattcaaatgccaacctccggttctgtcatcacttctggtcaaaaccttcagcaattatctggtaaggatcgtgatgcattacgtttaaaagagattggatttgtcctccaatcatataatcttgttccttatttgacagttgccgagcaatttactttagtcgacaaaataaagcccaaaaacaatttgcaccatgatgaacttagccaattgttaaaagatcttggcattgataaattagttgatcaatatcctgcctctttatctggtggtcaaactcaacgtgttgccatcgcgcgcgccctatatcctaatccatctattattttagctgacgaaccaacagctgccttagatagttcgcgtgttttaattatagggcaactactttctgagcttgcacataagcataacaaagcaattgttgtcgtaacacatgatatacgtctaaaaaaattttctgatcatacttttaaccttatggatggaaaattaaacgaactataaaggcttcaaagaagggaacctaagtcaaagcaatggttctggtgcaaattttcctcgctgacttgattttagtatactgggtgccaagaaacgagggattgcgcgcatgaatcactttaagggacgccactttcaaaaggacgtcatcttagtagccgttggctactatttcagattcagtctcagctatcgtgacatcgttgaattgcttcgggatcggggtatcactgttcatcacaccacggtcatgcgttgggttcatcactatggccccatctttaaggctctatggcgtcggcatcaaacagctcacgctaaaagttggcgaatcgatgagacctatattcgagttaaaggccgttgggcctatttgtatcgcgctattgacagtaacggtttgaccatggattttgagctacgaaaacaccgcgattataccgcatcctatcactttttgaagcgtctcttgacgaccaatggtcggcctgatcgattagtcactgatcaatatcgggcaacactgaaagcagtgaagcacctgataaagcaagactatttgagcaaatcagcccaccaatgttccaaatatcgaaataatttgattgaacaggaccaccgattcattaaacgtcatcgtgtccgctcagcaagctttcaaagcattcgaaccgctagtgcaacgttgagcggtgtggaaattgttcacgcaatacgcaaaagaacccgacgagagttaagtctcatcgggttctcagtcgtggacgaattagaagcattgttagctgcataaccttcaacataggatcaatagctggttagatggtcatctctcacactgtttgcaccagatcctttaactttaactgttcaggaccgcccggctgatcaatcacaattgctttcaattctgatcattcccttcttcattttactacagacttatcataacgccaattgaagcgggcttcagtcaaagaagcttttccaaaaagaaaaagccaaaacaacataagctgctttagcgactttgatttaaattttttgttcaatcttatcgatatcgactttcaaaactctggtaatccaaggaaatttcttcttcattgtatcgaagtcatcaccggatgttaagaattggccggtcccataaacgtgaaagccggcaccgggtccctgggtaccttcgacctctttactcccaaccgttataatcacgtggttgtcagttgaaaaatcctgctctatgctgtgcatgccggccgccggaatcagcaattgcttgtctgttacctggacgtatgacatccaggtattaacaacgtgggctggttgcgcattaatggttacaattgtggcaggaccctcatgcttcatgacatctaaaaatttttgatccatcgtaatactccccttcatcaacgtttcagtgatcgcaacttgatcattatcaccaataatcattttacaccaccaaattgatcaaaacactttttttaaaaaacgttcttcaagatctttctcatttcgagatgaaatgagtgatgacgtagtgtagaatgataggaagttctttaacatcacgtataaccatcgcaccacaaacacaaaaacggaaaatgagactgattttatttccccctggcgaattgtcaaactaagtgcaacggtttgtcaaaaaatacttcatatggggtttcatagtttaacactttgcgaggacgttgatttaactgcttttggcggtgctcaacgtcctgttccgtataattatcaatatctgttcgcttaggaaaatattcccgaattaatccatttgtattctcatttgttccacgctgttcaggcgaatatggatcgggccaatagacagtaacacctaacctttcgctgatttcatcaagatgaagaaattcggtcccatgatctggtgtaatagaatgaacaaattctttacctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaatacatcgccgcgaccttaggccgctctcgtatttctattaggcatgagcttcaccgttgccctgaaggtgattactgcgccattatagctcaggatcatgccgatacttgtcggcatcgttgtggtcggcactcgattttaacgcctaagttgaagcggatggtaactgagaagctaaacctaggttggtcccctgaaatggtcggttatgccgttcactgtgcgccacacacgatttaccactggatttatcaaagacaagtcgattttcagccaagccaactctttgatcacggtaaacgtcataaaagaagacaagaccttcggtcgcgctataaccaagcagtaggcacctcaattgagattcgcagtgagtcagctaatcggcgaaccgaaaaaggacatttagagatggatacagttcgcggtggtcgcgggtcaaaggctgctgttttgaccattgtcgatcgggtgacacgtttaatggcgacaactaagcttgaaaacttatcacaaaatgctgttctcaagggatttgcaagactgatggtggactttccgggtccggttcgatcagtgacggttgatcacggtaaagagttttcctgcgatcaggcgcttacaaagcgctatcggataccggtttacttttgccatgcctatcacccgaatgaacggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggtttaggaatggcccctaacagttcaactaagcctttatttatctcctgcgagtccttttgcgcaacctttttgataagcgtaagccgactaagccgatcgacaaccgttaaaaggatggagtgacccgttcgaccaatcacagtatcaatttcccagtcacctatacgttgacgctggttgataaaaccggggcgctcatgaattgagatatagtccgtctgtacttctcgatgtcgtctagtattctttgaatgtcgagtccgatgtttatgtctgagatggcgctgaataccggtatcaccacgtgaggagtacttctcacctaaattgtgttgatagatatgacggtaaatggtgttgtagctagtggctgcttaaaaattctataattcaggcagttaagctaatatatgcattattgcggtataataaatccattggaattagctgttttcctgcattttccttgcattttttgggaacctactcggaggttatcgtatggtctatcgtcacagcccacttcaattgtcatttgaatcctttggtgccggtttaagtaccccacttagctctaacaatgagtgggtccagttggcggaggtcatgccctggaaagctctcgatgaggcataccaattggagttcaccaaaaatgcgggacgtgcggcaaaaccatttcgtttactctatggggcaatcctgatccaacaacggatgggtttaactgatcgtggggtggttgcggcaattcgtgatacacccgcacttcaatatttcatcgggttgtccgaatacaaagcggttgagccgttcaattattccagcctggcacactttcgcaaacgaattgccgatatctccgagctgattacgaatatcatgaatgatacagtacgcgccaagatcgaagcgttggtcccattcaaagtggacaccgtcatcacggacgcaaccgcagtgccagtcaaaatcaagtatcctcaagacaccgtcctcctcaaccaagcaaggctgaatcttgaggcgatggcgatcgatatggcacaccaacttggtgtgccaaacccacgcatgtacaaacgcgaggcgaagcattgttggacctcattttcacgacatccaaagcaacagcgtggtggctttcataaacaggtcaaggcccaacttcaatatgtgcgccgtgatttgcggtacatcaacgaattcatcgatcagggtgcgactctaccagatgaacaagcgattcgcttaggcgtgattcgaattctatttgaccagcaatggtacatgtatacccacaagactcaccacgttgaagaccgaattgttagtctccaacagccgtacattcgcccaattcaacgtggtaaggccaatgctaaagttgaatttggggcgaagattgactgttcgttaagtgaaggcgtagtcgacattgaacgttttaatttcaccgcattctctgagggccaagacttcgcggaaactttagaccactattacgaccttcatggacattatccggatgaagtactggccgatacgctgtaccgtaatcgggagaacctaaagctgtgtaaggatttgggtatccgaatctgcggtccgaagcttggccggcatccaaaacacgttgatgcagcgaaacggcgtgaggatactgatgccgagaatcgaagaggtaccattgaacgccggtttgcttttatgaagggcacgctggggcttgacttggtgaacactcggacagctgaatcactggccgtcaagattgacgcggccatcgtcttgagcaatgtgctgaccctgttaagggtatttgctataccaattttaattttggctaaattcgagggtgaggcctatcaaattcgctataaatttactacaagggtcgaagatatggtggcctagttcaacagccactattgtagagctaagacttaactgttgttacaaagcttaagcgagtttaacgcgatgccttcaagctttacgaaatcgttataaaatataggcttttctgaaacgaaaaaccgttgcgcgcgtcagaatcgacgttgcgcaacggtttttaaattagatactgcaactttcgcaggcgttggcgccgatttccgagtcatcatcagtgaaggtacggatatagtaaatcgacttgatgcctttcgcatgggcgtagttgcgtaaaatgttgagatcccgagtggtcattttgttggtgcggccatctttccaaggataagtgccttctggaatcgtggagcgcatgaagaaggtcatcgacatgccttgatcgacgtgttgttgggctgcggcatagacatcgactactttgcacatgttagtgtcataagctgattgataatatggcaaggtgtcattagctaagccagaagctgggtagtaaatcgtgccgatggttttttcttgacgatcttcgatgcggttgacgatcgggtgcaagctggaacttgtgtcgttgatataagaaatcgaaccgtttggtgccactgccatgcggttttgatggtataacccatctttcatcacggcagctttaaggtcagcccagtcttgcttagtggggatatgaatgtttttgaattgttcggcaacggaatcgaatttgatcgaccagtcttgattcaaatacttctcgaagtagctaccgtcggcgtacttggaagcttcaaagttatgaaacaccacgccgcgttcacgcgcgatttggttggaggcttttaagctgtagtagttcagcaacaagaagtattggttggtgaagtccaatgattcaggactgccgtagtgcatatgatgcttggcaaaataggtgtgcaagcccatcgcgcctaagccgatggagtgcgccaagtcgttaccattttgcaccgatggcaccacgtcgatggccgagtggtcggtgacgtaggtcaaagcacgcaccatcgcatcgacggatttttcaaagtctgggctttgcatcaagttcgggatgttggtggagccgaggttacacgagacatctgtgcctaacacatcatattcttggcggttgttcaacacgcttggcgtttgcacttgcatgatttcagagcacaagttggacatgatgatcttgccggcaattggcgaagcattgttggcagtatccacgttcatgatgtaaggatagccggattcttgttgtagcttggagatttcggtttccaagtcgcgggcacggatctttttcttggtgatgttcgggttagctaccaagttgtcatattctttggtgatgtcgatgtaagagaaaggctgaccatattcgcgttccacagaatatggcgagaataagtacatatcagcgtcggctttgaccaaatcgtagaacttatctggcacgatcacgccgaggcttaaggtcttcaagcgatacttttcatcggcattttcttttttcgcccctaaaaaggcgatgatgtcaggatggaacacgttcaaatacaccacaccggcgccttggcgttggccgagttggttggaatatgagaaggaatcttccaataacttcatcaccggtaaaacgccagaagctgcgccttcaatgcctttgatcggggcgccgccttcacgcaagttggaaagcgtgatcccaacgccaccgccgatgcgagacagttccaatgcggagttgatggcccggccgatcgcgttcatgtcatcggacacttgcaataagaaacaagaaactaattcaccacggcgcgcgcgaccagcgtttaaaaacgatggggtggctggttggtagcgttggtggatcatttcatcggctaagctttgggcaaggttttcgtcaccgccagcgaagaataaggcgttggcaaatacgcggtcttcaaacgattccaagtaatggtcgttgtcgtcagtttttaacgcgtattgggcgtagaacttgtaggcggccataaaggattggaagtggaagtcttgcgcggctaaataatcgcggagttgttccatgaatccaagcgaatacttgcttaaaaagtcgacttcataatagttgtggtcaactaaatagtccaagcggtctttaagactgtcgaaagttaaggtattgggatcgacattttctttgaagaaagcagccaaggcttctttgtctttggccaatgggatctgcccattcaccggaatattaatttcattattgagtttgaaatacgtcacttgttctggatcgatgtctttgaggcccatggcgaacgctcctttgttttttagcattgagaataatgctatgatactgtatattgtggttacggtcaaagcacaaacaacatcttgcagtttttggcttgtgcgtagctgtggtaaaatttacgcgcaactgacattttaacgtcaattcagagaggatgcacatcaactatggaaaattatcaggcgatcaactgggaccgcgtttcagacgctgtcgacaaagcaacttgggaaaaattaacggagcagttctggctggatacccgcgtgccggtgtcgaatgatatggacgactggcgcgaactagacgatactcatcaatgggtggtcgggcatgttttcggtggcttgaccttattggacacggtgcaaagccaagacggcatgcgcgcgctgaccactggtgccatcaccccgcatgaaaaagcagtcttgaacaacatccaattcatggaatcagtccatgctaagtcttactccaccattttctccacgttgaacacccaaccggaaatcgatgaaattttccaatggtccgactctgaagaatacttgcaaaacaaagccaagtggatcgtagatttgtatcgcaacgacccagatcccttgcataaaaaagtcgccaatgtcttcttggaaacttgcttattctactcaggtttctacacgccactgtattatttaggcaataacaagctcaacaacgtcgctgaaatcattaagttgatcttgcgggatgaatccgtgcatggtacttacatcggctataaatatcaaatcgcttataaccaattgtccgacgctgaaaagcaaaaacaagacgactgggcttacgacttgttgtacaagctttacgccaacgaagaaaaatatgccgccctttgctacgatcaagtcggctggaccaaagaagtcatgacttttgtgaaatataacgccaacaaagccttgatgaacctgggcaaagacagcatgttcccaaccacggcgtctgacgtgaacccgatcatcatgaacgggatcaacaccaccacgtccaaccacgacttcttctcccaagtcggcaacggctacttgttaggtcaagtggaagcgatgagtgatgatgattacaacattgacgtcatctctgacccaactgcgggggacgacaaatgatcaatttattttatgtttcgatttctggtaatacccgcgcgtttgtgaagcgcctatgtgcctatgcagagcaacaacacgcaaaaaacgctgacgcttatcaaatcaacgctgtagaatactctgaatctgtggatgtcagaattatggatcaaccgttttttgcgatggtaccgacttatttagatggaggagacggcatcaacaacggctacaaagaagtgatgaccttggactttcgcgatgaactcgacgccggcaataccgagaacttgcttgggatcgtcggctctggcaatcgcaacttcaatgcccaatttggcttgacggccaagcactatgcccgccgcttcaattcgcctgtgatcggcttgtttgaattacgcggtaatgacgaagaagccgccaagatctacacggctttaaccaactatcaaaaagatttcgagcaacgtggcgtcaagcgcgcgttgacccactagcatatcatgatcaaccaagccgagatattaattgtctcggcttttatcatgcaaatgttgtctggtagcgtaaatctttcaaccttttacaatcatgatcgcgagaccaacggtcgcggtgctttcaaaagaaagtcagcagctgcataagtaacctttcaataggcgcacagccctggggaaagcaccagatgccagggcttgtttgtcgtacctctggcacgttaaacaagattaaacgctgataaaagatctgataatgcgtgaatttaagtgacaaccatacgcattcggcagaaccgaagaatttttgtccggaccattgacattcttgctaggcatcaatggtgatcaaaacacttcaattcaagtagagccaaataagccggttgatcttagcttcaaagacggtgatactattactttccagtttgctggtaacggagataccgataagcttactttggatcaaaagtagcacttggagatttcatcttttgttatgggtttgggtgtactgagaatgttcttgccaatgcttctttctggacaaaatagctggactgaggatcagcttgggaagtatcctcattgttttacaatagggtgtatccgttcggacggactttccttaattgacaatcagcccaagcgtgtggcgtaccctaatttgtagaaaaatgcttgtttttatggtaccaaatggtaccataaagctagaggtgatttttatgactagccaagtacatttcagaatgagcgaaaaagaaaaaaaggacttcgagattgtcctaagtcgtgtggggttaactcccggggaagcttttcgtatctttgccaagaaatccattgaagccggaggaattccctttgaggtctctcagccaaacacacgtttaaaaaaggctattaggagtcaagattacgttgaatttaacgatcctgaggaaggactggattggttaaatgaataaatttgtttataaaccagcctttgaacgtcaatttaaaaaacattacaagacgattttaaaaggggggcgctataaaaaagaagattttgaagctgtttatcataaactattacgagatgaaccgttagatccgcattataatgatcacgctttggttaatcgtaaaccagagcgtgatttacatatcaagccggattggttattaatttacaaatatgatggtgagtttgtgcgctttatcgacacgggttcgcattcagatctttttaactgaatttgcatttgaatcattgccaacataagacctgcatggttcagcattaatgttacgttagggtgtaccctatcgtatccacttgtaaactcaacaaacgctagcaacaaataagtgacccggtggccatttttaaatggatttcaataaggtagcttagtgggatcttacgtgtagtaacttgaaatggagacgaaatatgaattggcaaaaaatttgggcggtaaataaatattgggtaatgtcgaaatcacagcaacaatatgaccacattcgtttattggcaaaaaataatcaatggacgccacaaaagtcacaagagttagataaaattcttgattcactcgggtcagtttcaccaacaagaaaaacgttagtaacgacttatcaacatatctggggatatttcaagaagaaatgtaccgatgaagagttacatcaatatctgaagcttttagatgagctacaacctgataatgatagtctcggtcctttcttagttcaattaactgccaaataccaaattgattacctccaaaaatctagacttataattgagcttaacgaaagagaaggccaatcaatttctaagaattagacttttaattcaccggttccaatcaattatgcctttgaaaagaacgattagcgttgcccaacaattcagccactccaaaattgattgctaaaattaggactaaccaaagaagtgtaatcagaaattgctggttacttgactatctttcagaatatttgcaccagaatcgaaagaagtataggcataacttcatggacgcaaaaacgcctcaccactggatttgattccggcgatgaggcgttttttagtatgtgctgtatttgtatctataattcaatgctctctcaatcattgaaatatcagctgcatcaaatttcttttttgccatctgtaccgatgataagaagtctttgttttttttcaaagatttagccagcaactttttatccttatcatcgagcttgattttataaagcaagtttgccatcgaaataatcatagttttgtgagtcttaaaatagcgtctgtacaattcgctttcagatgcacacaacttatcaaaatcctgctctgaatatttgggttgaagccccaaaattggattaacaagtagcgcggtggatgcttccattagattgacatatgcacccaactcatactgttgagcctccgtcatcttggtgtagtcagttccgaaggtttctatcttcacaatggcttctcttaatttctcagattcatctatgattcttgtaatgcgcttacttagttcgacaatagcaagttcgtatgatttgatgtcacggttactaataagcgtgtatgtattctcaagtctttccttatcgctgtttgtcttaaaaaacatcagaccgcttgctacaatagaaacgccggcaatcgtccagccaacaggtcccgcaagtgctaaaaaggcgctgcccgcagccattccaccgccaccagtagctaaagcacctccacctaaccatgccagcgctgcatttgtaaatgctgcaccactcaaagcagatattgctgttccggtagaagccgctccaaatgtggtcgcaatacccatagcagctgtagggccaagcgcagcaacagcaacaccggcaccaacaccagcaacgccttgaccagtagcttttacctccgctttcttatattccagttctattttctcagcctgctgtttccagttaactctgattgtttttaacttctcatatttcagcatgtttttttccggcacattgcgaatgcggtcaaataacgactgtatcgtggtcaatgaggtgtacaatgaactggtatattttcccagctcatttattttttgattcgttttctgtgcagcagcttttgctttctgttgcgcttttttaagttttgatgacttctttgccatattattttcctccaaagtacttgtcgatgtccggcttacttttcagaattctatttacgggaacattacgcacttctgctaatgttactgattttccaaaagcttctatataagcatcgcttttttcgaagtcactgataaacattaacaggtggtggtcgtcgtactgatgtgccagaattttcagaccctctatgtaattgctaacaataacggtttcctttgacgcaaaatcgaattctttctttgcgtgattataggaaatcgctctcctcgtttcaccatagagagatattgcaaatcgtccgactccgacaacgttaagtcgtaagacaaactctaccgcattaaaagtacctccaccagctataagcgatctgcccactgcatcaccgacatcaaccaaacagaatgtaccatgtgcaaccgtcaacattcgcttaactgtagcatttgagaatggttcacatttcttccacatgagcgcaaaggagcgttctgtctttggaatttctgaaaaatatctgaatagacggcgaatagcataaatgagtctaacaagaagctcgttcaaaaatactggtatagcctgagctgtctggaaccgaatatcatagcctttttcaaaaatgtttagagccagctcattcatagctttgtccgtttcagttacactaagtcccaatttagcttttatggcaataatgtcattggtccatgtccacaatggagatggaaggcccgtgccgcgattacctttggccgcacttgacgatgaaccggatacatccgaaataagatgacctatccagttagcaaatccacagaacagcttacttggaatatttccgcctcgtagttcccatttttcatctgcctgttgcaaagaaacaagttgaccgtctgtaacaaaatgagatgtattgctgaactggtcgagtatcgaaaagaacagtcccaacaaactcggattgtgtgcaagagatttgaaatgatgatttttggcagtcaaatcgaaaatagtctttccagcgtcacccagtccggtctggtcatatggaaccttaaatttcttctccaagaatctcaatgcggaatcaaggctatcaaaatttttcttttccggattgcacagttttgcaaaatctatcattctggctacaaaccatttatccgtaatattacctaaaggtgactcaccaggcttacccactaaaaaaatatcgatgataccacacaaggcaccagaacttgtagccaaaatataatccaacttatcacagtctggtttcagacctttaatcgaatctaccgtttcattcaaaacgacaagctctgtttcagctttcgccattgcatcagcaatcgatgtagaaaaatcaaagcccccatcctcaacgcttaaattaaggagaatatggttctggtgcaaagttcaataaatgactaagttctacccgtttaactgacactgttggcttcaggcagctattagttgttgcaattcagtgattactgaaaacccgaagagattgccacttcttcgggtggttcaggtgcaaattttcctcgctgacttgattttagtatactgggtgccaagaaacgagggattgcgcgcatgaatcactttaagggacgccactttcaaaaggacatcatcttagtagccgttggctactatttcagattcagtctcagctatcgtgacatcgttgaattgcttcgggatcggggtatcactgttcatcacaccacggtcatgcgttgggttcatcactatggccccatctttaaggctctatggcatcggcatcaaacagctcacgctaaaagttggcgaatcgatgagacctatattcgagttaaaggccgttgggcctatttgtatcgcgctattgacagtaacggtttgaccatggattttgagctacgaaaacaccgcgattataccgcatcctatcactttttgaagcgtctcttgacgaccaatggtcggcctgatcgattagtcactgatcaatatcgggcaacactgaaagcagtgaagcacctgataaagcaagactatttgagcaaatcagcccaccaatgttccaaatatcgaaataatttgattgaacaggaccaccgattcattaaacgtcatcgtgtccgctcagcaagctttcaaagcattcgaaccgctagtgcaacgttgagcggtgtggaaattgttcacgcaatacgcaaaagaacccgacgagagttaagtctcatcgggttctcagtcgtggacgagttagaagcattgttagctgcataaccttcaacataggatcaatagctggttagatggtcatctctcagactgtttgcaccagatcccggctaacttgttcttgcaatttgggttgagatctttttgcgtaatctgcgttactaaatttgttcaagttatttcttgcaatctgccgttttttattgtccaaaaaattttgagacagtggctaacttgattctaaaatgcgcggtataattaaaaatgaagctgtttggagaaactgattccattattaatgttgtgaatcttgaagccaacttatacgctcattgatgattggaattgtcgctgttctgtctttagggggaatcgccatgttgagtgaaagggctaagagcctgtgggcgaagaagcgaacggttgatggccagccaaagtggttaccgcttgtggcgcatttggtcgatgcttctaatgtttcccggatgctgtttaaccagtggctaagcgaccagcaacgtgtttttttgacagtggatcaagacgtagacaaaacacttaaactggtcaagtttgtaggcttcatccatgacattggaaaagccactcccgccttccaaacgaaaaaatcatatgttgaagatgccagtcttgatgccgatttgattgaaaaggcggtcaggactggttttgttggcttggattcaactcatctgccgtcggcgtcaaagtccccacatgccaaggccggcgaggcgattcttgagcggctcgccggcccggattccatcggtgcaattgttggcggtcatcatggtcggccgctaaccagggcgccacaacgtgatattggtgactacacatcgaattattggcaggccgaaaaggatccggttgttcagcaacggtggcaagacgtccagcttgagctcctcaattacggtcttgaaatctccggtttcaagtcggtggcggagttgccaatgatcagtcagccccaggcggtgctgcttgaaggcttactgatcatggcggactggttgtcttcaagcgaggcgcttgaagatgatcctggccagccgcttttcccattgatctcacttgatcagggcctggacgacttgaatttgacggcacggtatcagcaggcctggacccggtggcaacggaccgacgagtggcccactgcgcctgtgccgctagcgtccgacccttacaagcttcgctggggcttctcggcgcggcctgttcagcgaaaagtggccgagatgatcgatcaggccgaagatccggggatggtcatcattgaggcgccaatgggcatggggaaaaccgaggcagccttagtggcggctgagcaactggcgtacaagggcaaggagacgggactgttttttggcctgccgacgcaggcgaccgcgaatgccatgtttgatcgcgttgatgagtggctgaggcgattggctgccgacaacggtgaaacttattcaatcaagctcatgcacagcaaggcggaattcaatccgaattacctcaaggtccccgttgcggaagacgttgatggtgacgcctcggtggtggtcaaccggtggttctcgggcaaaaagtcgatcctcgacgagttcagcatcgggacgatcgacaatctgctgcaaatggatcttaaacaaaagcaccttgcgctgaagcaccttggcctgagtaaaaaggtcgtcatcattgacgaggttcacgcgtacgattcgttcatggaccagcacttgttccgcacgcttgaatggctgggcacctaccacgtgccgatcgtcgtgttatcggcgaccctgccgaaagcaacacgcaatcgcctgctcgaggcctattttcacggaaagttcggtcagaaactaagcaagggggcagacctgagcggggtctcttcggattggcaggacagcgaggcctatccgctggtgtcgatgctcgacgggcggcgactcaatcaggtcagccattttgacggtaaaaccaatcagagccagctttccattcatgttgagcgcatgagcggtgacttgactgcgctaggcgagcgtgtgcttgacgcgatcgcggatggcggagttgccggggtgattgtcaacacgatcaagcgggcccaagcgctggccgatgcgttggcggggaaggtcccttttatcgtgcttcactccgcctttgtcgccgctcaacgggcccagttggagactgagctgcaaaatgcgatcggcaaggggagcaagcgccccgccaagctggtcgtgatcggcacgcaggtgctcgagcagtccctggatatcgattttgacattctgttcaccgacattgcgccgatggatctgttgctgcagcgggccgggcggctccatcgccatgccattgcgcggccgcgcgcgctgactgggccccggctggtggtgacgggcattgaggggctgggcgagttcgaggaaggcagtgctgccatctacggccagtatctgctgatgaaaaccgaggcgctgctgccggccacgctgcggctgcccgatgacatctcccggctggttcaaaccacgtatgatttgcagcgtgacccaccattgccggggatcgaggaggaaaggactcgcttcgagaccaaaattgcgcaaaaggcgcagaaggctcaggcgtttcaaattgccccgccaagcagaaggcggagccggacccttcatggctggctggacaatgatcagcccggcgtggacgtcagcgagcaacgcgcggaagctgcggtgcgggatattgatgagtcgcttgaggttattttgctgcagcacacaaagcacggggatgcgctgatcgacggtcgtgtcgtcgactcgttccagcttgaccgaatggccaaggtgatcgcgcagcagacaatccgcttgccgcgggtgtttacctttaatatcgacgccacgatcaaggccctggagcaggaaacggcgcgcctctatccgggctggcagcagaataaatggctccgcggggccttggcgctgccgctggatgaagagttgaacggttcgctgatggattatcagctccattactcattgaaggatgggctgaggtattggaaggaggaccaagatggcaacgagacagtttaatttggtcacggatccctggatcaaggtgatccgcgcggccgattaccgaagtgaggaggtctcgctacaaaccctgtttcaacagtcatcagactatttgcggctggccggagaaacgcaatcacaggacctcgcgatcatgcggttattactggcaattttacacacggtgtactcgcgctttgacgcgacgggcgaaccgtacgagtggctcacgatcgatctggagtcgctgcaggtagcggaagcggtggagcaggatgactacgagcctgacgatctgttcgagacctgggacgccttgcatcagttgggtcatttttccgccatcgtgatcgagtatttggcgcggtaccaggatcgatttgatttctttggggagcggccgttctatcaggcgacccaaagcgaatatgacgtcttggtcccggagaagaaaaaagtggccactggtagcggaacggttgcgatccggcagatcaatcgcaccatttcggagagcggcaattcgccggctcttttcgcccccaggagtgatgctggcaaggatacgctcggcatggcggagttagtgcgctgggtgatcacctatcagaactacaccggggtgacggacaaaaccaaaattgtcgctcaggaaaacttctcaaatgactcgggatggctttatcgactcagccccgtcttcgctgtcggggacacgctctttgacactttattgctaaacctgatcctcgttcaaaacgaggacgcgccctatgcggttgaacgtcccgtttgggagcggccgaatgcgcaacgctatgtgcaggatcgagaacgtcagcttcagccggacaatttggccgctctgtacacgtcctggtcgcgagtgctctttcttcagtggggagacgatcgcctagagaacatctttagtgctggcgtaccaccattttcagcggacaacgcttttctagagccaatgacgacgtggcgctggatcaagaaggagcaagtttatcggccacatcggaaagcgatgacgtcagtttccaaggccatgtggcgtaattttggcgagtatgtggatcttcatgacgattctaagcggaggcagccgggcgtggtcacttggctgcagacacttaaggcgcggaagagcctccccggtgaaacccagatcacgttggcaactgtcgcactgatcagtgatggtaatgcaacctctcaggcgccggcagcggaggtggcggacgtcatgcgagtcaatgcggacgtgctgtttgattcgatgggggcccagtactggccgaaacgaatcgaggacgcgatcgaaagtacggacacggtcgccaagttctactggatctttgtcagcacgatcgccaagctccgcaacatttcgggaagtacctttgctgccgctgagcaggaaaagttttatcaggacttgaccattccatttgacaactggttgcgtacattgtcgatcaatgatgatcgggatgcgaaaatcgggcagtggaacgcgcaggtcaagaaaatcgttttgtctcgcgccaagggcttcatgacaagtgcgaccccgagagacatggccggattaacagacgagaatggcaatgaaaccaacattttcattgcctatcgccagttgctcggacgtgtgtccgagcaactcggtgatcgaaagggggaagtcaagtgacagaatcaattcagagcaccactgcccgcattattagacagctatacggaaactcggaaccgaataaggccgttcttgcggggctcagaggagccagtcggtttactgatgttcaggcgcggtcggcatggccaatcatcctggacgggctggacgatcaatacctgagccgtgatggcatcccaacgtatggcgagcaggccattttcactgccacccatctgtatgccgtccatcagcaggggcacgatcagagcgtttatgggtcggccgatcccaagcgcgatgacaatggcttcccggtgttcaaggcgttgtcgatgttgcggacgcgggcagatagtaagacggccatcgatcggcgagtgcggcaggcgctggccctgaccaactacgaggcggtcgtgaatgcgctgggcagcttaatcggcattgtgaaggcgaccaagctgccgctgaagctagattacgcgcagctggcggaggacttgtactggtttcagatgagctacgaacaggcgagtcgggtgcgactgcgctgggggcaagattattatgggactgtttccgcaaacgaaaggacagagcaaaatgactaacaaaaacctctacatcgacattcacgtgcttcagacggttccttccgccaacatcaaccgggatgacacgggcgcgcccaagaaggcgttatatggtggcgtcacgcgggcccgcgtttcctcccaaagctggaagcgcgcgatgcggcttcgcttcaatcaagaggatcacgacgatgccgggcttcgcaccaaagaagtgccgcagttgctgcggcaggccctgaaagcggcggcgccggccttgaccgatgaggaaatcgcggccaaggccgatgcggtgttctcaacggccaaaatcaaaatcaccaaggatggccagaccggtgccctgatgctgatcagcaccggccagctcaagaagcttgcccagtacgccttggataatgaggcgctggacaagaaggagctgaccaagctgttcaagggcgagcagtcgctggatctagccttgttcggccggatggtcgccgataatcccgagctgaacgttgaagggtcggcccaggtcgcacatgcgatctcgacgcacgaaatcgtcccggagtttgactacttcacggcgctggacgatttcaagcccgaagacaatgccggggccgcgatgctgggaacggttgagtacaattcctcgacgctgtatcgctacgccaatctgaactttcaggagtttgaggcgaatattggcggccgggctgccgtgtcaggggcgctgagctacatcaaggaattcctgctgtcgatgccgaacgggaagcagaacacttttgctaacaagaccttgcccaattacgtgatggtgacgctgcgcccggacaccccggtcaacctggtgtccgcgttcgaagaccccgtgaagtctaatcatggctacgtcgaggcttccgtcaagcggctcgagcaggaatatcaggacgcgctgcagtttgttgacgcgcctttgttcaccgccgtggtggggaagaccaacggtgaagtcggcgagcaacaggccaacgtcaacgggttgcttgatgcagtgggtgcggttttgaagaaggcggtcagcgatgaaaacgatctcgatcaggctaactagcccgctgcagtcgtacgggaatgaggcccagtttgcgcggcggacgaccggggattacccctcaaaaagtgcgattgtcgggatgcttgcggcggcgctgggctatcaacgcgacgatccggcgatcaatgcgctcaacgacctgctctttgcggtgcgcgttgatcagcccggccaggtgatgacggagttccagactgcggagtggaaacccggtacgcggaagctgacgtatcgtgacctgcttcaggatgccgtgtttgtcgtggccatcgggagcgaggacgaggcgtggctcgaccggctggccgaggcgctgcgccatccgcggtttcagctgtacctggggcggcgggccaacgtgccggccggcgtgttgaaaattcagaccttcgccgggcaggatccggtcggggtgctggcccagctgccttggcaggcctcgcgctggtaccagcggcgttcgcggcgtcaggcaagcatgagcgttcagttgatcgcggatgctgtcctgttaccagagcgccgggccgatttggtcagggatgctgtgcactcttttgaccaaaagcaccggcaatacagttttcgccccatcgccgtgaccaaggtgcagctggccaatccggaatacaagccagcgcccacggccactgcgcaggatgccttcggtcaagtatagagaggaggtacgtcaatgtatctttcacgagtccaagtgaataccaatgatcaccagattttcaagcacctgacccaccttggcgcctatcacgactgggtcgaacgcagctttcctagagaaattgctgcgggaacgcggcttcgccacttgtggcggctcgattccctgaacggcagggattacctgctcgtgctgagccccgacgcccccgagttggcgcagctcgcccgctacggcgtggccggcactgcgcagaccaaggactatgacccgttcgtgaccgccttgcgtcaaggccagcgcctgcgctttcggttgaccgccaatccgacccggacaattgctaccccgggccaacgcgggcacgtggcgccgcacgtaacggtggcccaacagatggcctggctgagtgagcgtgcggcggcgctggggtttgaattacccattgatgatgacggcccccagtttcagattgtgggccgagactacccggctctgcggcgggcgcaggggaagccggttcgactgagccgggtgagcttcgaaggaactttggtggtgagcgacttggtgcgcttcaaagagaccctggccaccggcatcggccgcgagaaggcctttggtatggggcttctgacggtgatcccggaagcgtggtgacaagatggagtcgggcgcaaaaaaggcagatctgaccgagctcagccgggtacgcgagcgggtgacttttctgtatcttgagcacgccaaaattaaccgccaggatagtgccatcgttgtcatcgatacgcgaggcaccgtggcgatccccgccgccctgatcagtgtgctcatgctgggtcccggcgttgacgtgacccatcgggccatggagttgatgggagacgcgggaatgagtgtggtgtgggtcggtgagcgcggcgtcagacagtacgcccacggtcgcgcgctgactcattcgtcggcgttgcttgtcgcgcaggccaagctggtgtcgaataatcggctgcgggtcggggtggcacggcagatgtaccagatgcgctttcctgacgatgatgtgtccacactttcgatgcaagaacttaggggaaaagagggggcgcgagtccgccggatctatcgcgaagagtcccggcgaacgggcgttgagtggacccaccgggagtatgatccagaaaattatcaaagtggttcgatcatcaatcaggcgttgacggcggcgcacgctgccctgtatgggttgagctacagcgtcatcgttgcgctgggggcgtcgcccggactggggtttgtccatacgggccatgacttgtcatttgtgtatgattttgccgatctctataaggcagaagtcacgatcccaatcgcgttcaccgttgcggcgaacgcaacggagcaagatgacattggtcaactgacgcgacttgcagtcagagatgcttttgttgatggcaagttgatgatccgcatggtggcggatctgaaaatgttactcggtgacgtggacgatgatttggacgcggacgtggtcaatctctgggatgataagcttggactgcagaaattcggcgtgtcctaccgtgagtcaacggaggacgggcaatcatgatcgtgatcacgttatccaaagtaccgccatcgctcagaggcgttctgacgaagtggtgccaagaggtccagaccggggtctatgttggccggtttagcgcgagaatccgcgactctttatgggaacggatccagcgtgatatcgggtcgggcgaggccaccatcgtctttaacgcaaaaaacgaactcggctaccagttcagaactacccagacggatcgggaggtcgtcgattacgatgggttaccgctcttgctgagaaagaacacgaaccctgaattggtccagcttggcttcagcaacgccgcaaagtttcgcaaagccaagaaatttgcccgaggaaagccgccgacgaacgcgacgaaggttgctgaaggcgttccatttgtcgccttggatattgaaactaccggattggatgctgaacgagatgcaattattgccattggggcggtaaaaggaccgtcagttaacgaaaccgaaaaattcactaccttggtgaatccacgaaggccgcttccatcaacggttgccaagttgacgggattgtcggcggaggagttggttgccaatgggatcagtctgagcgaggcagtgcaggccttacgggattttaccggctcgctccctttagtcggatataatctgcgtttcgacatgggatttctttcggcagcgggtcgtgaaactgggttaacgtcttttgggaatcatacttttgatttactaccgcttgttaagaaatccagtcgctttctggataattacaagcttagtacagtgctggcacattatcagatcgataacgagcaaccgcatcacgcgttgtctgatgcgacggcaacaatggcactggcggacaaactcataaaaaaaggaatcttaacgattggcaaacgttgatgggatagggattttttagtgttttccccgcacatgcgggggtgatcctgaacgcggttctaatgtctgacaacaacggcggttttccccgcacatgcgggggtgatcccacgtcccgcttcgtctcattgttcatcgtcaggttttccccgcacatgcgggggtgatcccgcctcggcttgattgagcacctgagcataccagttttccccgcacatgcgggggtgatcccccaactaacagagactttttcatagtgaattcgttttccccgcacatgcgggggtgatcccgaagttacgccgccacaaacgccgaagcttgtgttttccccgcacatgcgggggtgatcctcagtccttcgtccagaatgtcctgaatcacgcgttttccccgcacatgcgggggtgatccctgtgtttcccatagcacccaacccccaatcccgttttccccgcacatgcgggggtgatcccgtcatgcaaacaacaagggggacaatatgaaggttttccccgcacatgcgggggtgatcccaacacttttgctccgaaggttgattcgatcgggttttccccgcacatgcgggggtgatcctggtgttatcaataaattgattgccaacatagtgttttccccgcacatgcgggggtgatcctgacaaggccaatacggcttaacaaaacatcaagttttccccgcacatgcgggggtgatccctatacttttactggtgcaggcaaaacttatccgttttccccgcacatgcgggggtgatcctgggcgaaccgttgcacaggacacgccacagcagttttccccgcacatgcgggggtgatcctggattcgtcaaactcttagttttgagaatgacgttttccccgcacatgcgggggtgatccccatagaaagaggcacaacgacactcccaccaggttttccccgcacatgcgggggtgatcccacgctgaaacagatttcggttgatgttgctcggttttccccgcacatgcgggggtgatcccagaattaaaattaatggcgccaatcttatcaagttttccccgcacatgcgggggtgatcccaacgctagacgacgcaactcaagaacaagtcggttttccccgcacatgcgggggtgatcccaagctaacctttcgcctagatcgtcttgatttgttttccccgcacatgcgggggtgatcccaaaagtctgaacgcgtttatcatctcgatttcagttttccccgcacatgcgggggtgatccccatagcggcgtcaacattagtacgctcaatctgttttccccgcacatgcgggggtgatccggggatgactgtatgaacgaacgcaatgaaaaagttttccccgcacatgcgggggtgatcctttcatggtgccctccttattgctgtggagcaagttttccccgcacatgcgggggtgatccctaatgttactgatatttttatcaagccatttggttttccccgcacatgcgggggtgatcccactttgtattttccagccatttcccacttcacgttttccccgcacatgcgggggtgatcccactttgtattttccagccatttcccacttcacgttttccccgcacatgcgggggtgatcccgctgtcttgcctcacgcacagtttcagcagccgttttccccgcacatgcgggggtgatcctggagatcaagatgagtattatgcatacgttgggttttccccgcacatgcgggggtgatcccgactgatacttctctgaaccggttcatttgtggttttccccgcacatgcgggggtgatcctgccattccacagtccgctgaagaatgaagcgagttttccccgcacatgcgggggtgatcccacacgatgacgagcttggcagtcactcggttagttttccccgcacatgcgggggtgatcccctctgcccagtcaccaatcgtgtatccaaaaaagggttctggtgcaaattttcctcgctgacttgattttagtatactgggtgccaagaaacgagggattgcgcgcatgaatcactttaagggacgccactttcaaaaggacatcatcttagtagccgttggctactatttcagattcagtctcagctatcgtgacatcgttgaattgcttcgggatcggggtatcactgttcatcacaccacggtcatgcgttgggttcatcactatggccccatctttaaggctctatggcgtcggcatcaaacagctcacgctaaaagttggcgaatcgatgagacctatattcgagttaaaggccgttgggcctatttgtatcgcgctattgacagtaacggtttgaccatggattttgagctacgaaaacaccgcgattataccgcatcctatcactttttgaagcgtctcttgacgaccaatggtcggcctgatcgattagtcactgatcaatatcgggcaacactgaaagcagtgaagcacctgataaagcaagactatttgagcaaatcagcccaccaatgttccaaatatcgaaataatttgattgaacaggaccaccgattcattaaacgtcatcgtgtccgctcagcaagctttcaaagcattcgaaccgctagtgcaacgttgagcggtgtggaaattgttcacgcaatacgcaaaagaacccgacgagagttaagtctcatcgggttctcagtcgtggacgagttagaagcattgttagctgcataaccttcaacataggatcaatagctggttagatggtcatctctcagactgtttgcaccagatcccgataaagttgattaacaatttcgctaaaggcgatgatgggatgaaaagcatgacgaaatgggtaacacggtggcccgaacgaattagttacggcttaagtgatgccgccgataatttagtctttcaaatgatgacgacctatttgctattcttttacacggatgtttatggactgacaccaagcgcggtggccattttatttgtcgtggcgcgggtagctgacgttgttgaaagttttgtcatcgggatcatgattgatcacacacattcacggtttggcaagagccgaccgttcttcctctggtattcgttaccttacgttatttttgcggttctcacctttgtgacgcctaacttttcgtataatggtaaattaatctgggcatatgtgacgtatttaggccttggatttctgtatacggctgttaatctgccaatcacgtcaatcttaccaacgatgtcgcagaatactcgtgagttgacgttgttgggtgtcattcgtcaattctttggcagttcggttcaaattgtggtggcggtattcacattacccttggttgcgttcttcggccacggtaatcagcaaaaagggttcttgggcacaatcttcgtgtttagcctgatttcatttcttttgattatcaacacgtttgtccatgttcgcgaacggttcgcgaatcctgaaattgcccatcaaccgttaacaactgtcctaaaaatgttgaaacataatcagccatggatcgttatgtcaatcgtgattctcatgtactggctggtgacggcaattaagaatcagacaaccatttactattttaaatatacggtgggaaacgaaaacctggtaccactagctaacagttttaccctggcagcgttaatcggggtattgctgatcattcgaattaccgaggttcgcagtaagaagcaaacgatgcttcgcggtattttaatggcgctggttggtcaagccgtgattgcggttggggtttataccaaaatactgtggttcttgtttggcggtgtcttgattaactcgattggcaatgggatcattatcggcctcgtctcaatcatgattgctgacacaatccgttatggtgccagcatggggatccaagccgagggaattctggcttcaacggatgactttggcgttaacgtcggccttggtgttggcggcttgattacagctggtttgtttcacttttcgggttacgttgccaatcgaacccagaatgccgcaactctcaccatgattgatttgaattatgtttggattccgttggttatttatgtggggatgtattttgtattgcggctttatgatgaggggcggattgaacgagcaatagaagcaagaaaataagtccgaattatattctaaataatagtttttgatttgctaactaacaccggtgcggtgtgatattattacctttttgcgccaacggttattgcaattggctaaataatcttgcaacctcacttttgaaatgcaatagattgtgagtcgttccagttagcactatactgaaactgagtctaaatctaaaaggagtggtttgcatggctgaaaagtatacagcagaaatcgtgccattgaacgctgagaagattggcaccgcgccgcacggtgccgcgacgttcacgattgatggtgcgcaaatgaagattcatatcgatatgtttgatacacctgctaatgtgcagcattgggaacatttccacggattcccggatggtaagccagcagaaatcgccacagcggcacaagatgctaatggtgacggtttcgttgatctgccagaaacagaaccggtttccggtacaacgatggtgccatttgacgctgaaccggccaagatgcatgtgccaaatgacagttacccagtggctgatgcagaaggtcactatgcttatgacaaactcgttgatctgaaggaattgcagacagcgtttaaagccgcttttggcagtgacgatttgcagcttgataaaagggtcatttatattcatggtgtgccggataccttgaagctaccggctactgttcaaggaactgtcatgaactacgatgcccacgttactttaccaattgcagttgggaaaatcatcaaagcttaaactaattagttgaataaataacctataagtggtcttgaaacttactggcaatacgcctgctgtttcaaggctacttttgggtttgaagaccttatttacctataaatagagatttttacattatatgtacagattaatacctataatgtcaataagtatgcaccgttaaaaatatattgttaaataacgaacattatcattcctttgcgcggggtcaacttgttaagctggtgttggaagaagagagacgccggaaacaatggaaggaggcgcacagatgcctaagaagttgatccatatcgtcatgttggcgatgttgatgctgacccaggtcggcagcgtcgttgtccctgtagccgacaacggtgagacaaacatcaccgaacatgaccgtgcggcgccaaaatccgatccatcctcacaccagaacgatgcgagcggacaagcggcaattagccaagacacaattgagtctgacaagaaacagacaagtgcagcaatgagcagttctgagaacctgtctagtatcttttaagaactatcttcaggaaggccaatacaaccatttgaagactgctgttaagggcgcgttcacagtttttccaaagtcgccgacatttgtctagccaactccatgaacgttcaacgatccatcgttgcggtagcaccgtgaacatatgcaactcgttgcgtttagctaccatcgtcttagcattcaaaatgagcttcacctgatccgcaaagtcattgccagtgtagccaccatcaaccatgacatgctgaaccagctctaaattttggctagccaaactaaacatagccaatgcacctgaacgatctgatacattagctcgtgtcacgagaatggcttgtggtaaacgattaatatcaaccgccatatgacgcttaatccctgaaatctttttgccgccatcgtagccactatttttcgttaaatcagtggttttaacactttgagcatcaacaatcacaaacgacgttcgggccgatcggccctgtgcaaaacgataggaagcgacagttttttaaaagcctttctaatagcgaatcagctggcgggtctggtttatctcgccacatatcgtaatagcggtagacagtgtgccattccgggaaatcgtgcggtaattcacgccattgacaccctgtagtaagcgagtaaaggatggcattgaatacgtcataaagatcataacgacgcggtcttgtatgcttacggaagttttctaaatcaggttgtattaacgcaaattgcgctcgagaaatattgcttggataatctggcatgacaaactcctcagtcggttttccacaattctaccagattcagcagatactagacaggttctaataacttggccttgaggtcgagaccgagccgactacttttttcaaggccgatctgctcatcaagcaaaaagatgcgttcattggtacgaacatcttcatagtaccgacggcgaaaagatacagtgccaatgctggtatcgacatggcgttcacgcatatctttgattttaaaaaactgcttccggtaggaagaatccgccaaaacctgatcttgttgttccagcatgacaccaagtaattgacaaagagtctttccaaaacttttttgagtttcgatgactagattggcaaagtctaactttcctgtcagtaaatcaaaggcagagtttccaaatgatgtcatcatttctgtgatgatttgttgtaagatagagttcaagagtgattcctcctaattgctagctggttgatttgtcattaacattctagcatgagtagggatcgctccctttttgtttctgataatttacccacttaaactttacgctaagccttaaatttcatctgttgtcctgtattatataatgagtctgtaattttgggagaatttaaaatttactttgtaaaaacagactagtcttttctttcgttaagctcaattataattctagacttttgaaggtaatcaatttggtacttgttagttaattgggccaaaaaaggtcctagtttatcattgttcggttgcaaattatctaataatcttaaatactgatgtaactcttcatcggtacattttttttgaaatatccccaaatatgttgatacgttgttgttaatgtttgttttgttggcgaaaccgattcaagtgagtcaatgatgttccctagttcttgtgtcttttgtggcgtccattgattattcttcgccagtaaacgaatgtaatcatattgttgctgtgatttagacattacccaatatttgttgactgcccaaactttttgccaattcatattttatctccattttatgtcattatacgtaaagcatcagagcgttctactgaagtagattgaaaagcttacgctaaactcgtgaatggaccttcatgagttttgtgtctagtttgcttggttaagagacttcaacttcagattgaaagagcacctttcaagaaactttaattgtttatggtggctaccgtgctcacattaacaagtaaagccatccaaaaacacccaaaattaataaaccaatcagatttaacacagtgaacactttaaggaaatgccacaatgactgttcttcgctaaacagcaataattgttttactgcaagcaaatttgcaagggaggccacaattgatcccaatccacctatgttaacacctaggaataaggctggtaagtactttgtaaaattggccagtaagatagcggctggaacgttactaatcgcttggctagtcattaggctagcaatataaacgctctgcggtgtttgcattagctgatttaaccagagagtaatataggagttgtgactaatagcactaacaaaaaggaaaaagcagacgaatgttaagagcaaagcgtaatcaacatgttgaaagacgtgccaatcaattctcaaaccaacaataatagtaacaataataactaatgaaattggtatcaagttaaaaattccgagcataataaacccaatcagggaagttgcaacctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaatacatcgccgcgaccttaggccgctctcgtatttctattaggcatgagcttcaccgttgccctgaaggtgattactgcgccattatagctcaggatcatgccgatacttgtcggcatcgttgtggtcggcactcgattttaacgcctaagttgaagcggatggtaactgagaagctaaacctaggttggtcccctgaaatggtcggttatgccgttcactgtgcgccacacacgatttaccactggatttatcaaagacaagtcgattttcagccaagccaactctttgatcacggtaaacgtcataaaagaagacaagaccttcggtcgcgctataaccaagcagtaggcacctcaattgagattcgcagtgagtcagctaatcggcgaaccgaaaaaggacatttagagatggatacagttcgcggtggtcgcgggtcaaaggctgctgttttgaccattgtcgatcgggtgacacgtttaatggcgacaactaagcttgaaaacttatcacaaaatgctgttctcaagggatttgcaagactgatggtggactttccgggtccggttcgatcagtgacggttgatcacggtaaagagttttcctgcgatcaggcgcttacaaagcgctatcggataccggtttacttttgccatgcctatcacccgaatgaacggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggaatcaaagatattggttacttctgcgcaaggaagcccagggctttttttaggatttcgttctcctcagacagcgaagccagtcgcttttccatcgctttgatttcgtctggcgatttaccggattgagttttggcctggccctggatccacttatgaactgttgaatagccaatgccatattctctggccagttgggcagctgattcgccttgcttatataggttgataatgttttgtttgaattctttgtcgtaacgagttggcatgtaaaaattccttccttttgagagatgatttattcattataccctctattaaaagttgtctcaggaatcagcttacatccaatatgttgattagtaactatcagaacgacagtggggaccagctacgtccgtacgagtcacggacgtatctgataaattagaaaaattcacggaggtggctattgtgttctcttttttaaagaagaatacagctcaggttgttgcaccagcaacgggacagttgattccaatcgatcaggttgaagatgaggtcttttcaaataagatgatgggcgatggctttgccgtgagaccaacagaatgcggagtcttcgcccctttagctgggaagatcacgactgttttccctaccaaacacgcaatcgggatcacaaccgaacacggacttgaggttttagttcacatggggttagataccgttgagttaaagggcgacccgttcacggtctacgtcaagctcaatgatgaagtaaaaccgggcgatcagctcgcagatatggatctacagaaggttgccgctggcggaaagacaaacacaatcgtcgtcgtttatacgaatatggataagctagaagatattccaattgtcccaactgcagaagtgagccatggagacgaagttgagaaattaaaatatacgaagtaattggcactgactctatggctcctatgctgtaattacggacaaaaatagtttgtgcgataattgacagatgaggaatattttatgaccaatacagctattcgctacacccccgaatttaagcaaaccttgattgatcttcatgaaaaaggacactcattcaaagaactacatgaagaatacggtccttccttagacactattcgcaaatgggttcaggcggccactgtcattgccattgatcatcaaggtactgctgtgaccaacgaacagttcaagcaacttcaaaaagaaaatcgccgtttgagggaagaactcgatattttaaaacgagcggcggtgttgctggcaaagcgttggcgctggtccgcgtcaagtagacaggtgaaataattaaagtgcctatgcagttttctttacggcatgattccggtatgtcatcggggtcatgccgtttagtgtttcttggcggcgttcgttgttataccagttgattgccgcctcaatacgcttcatcatttctagttccgataagcagtgctcaaaggaaaatctctcgatcttgaggtgactccacaagctctccatcgggctgttatcacctggtgtcccgggtcgtgacatgctgtgcgtgataccttcgcccgccaggaacgtgttataggtgctacttgtgtaagccgtgccctgatcactgtgtacggtatcaggcttgataccatcgttattctcgatggccagtttcattgttttagtagccaaatcagccgtctctgtcggtgctacgcaccaagcaatcacgctgtggtcatgaagatcctttacggcgcttagccgtagcctctgtttgttgtccttgccgtaggtgatctctgagcagtcggtcacccagactacgttaggagcgactgggtggaaggcgtgccccatgttgacggtgtagagcttattgacgaggagaaacgccttcttctccacttgacggtcacgctttgccacacgaatggaggcgcggatacctgccaaccgcatgattcggcgaactcggccgtgactcacgtggtattgcgtctccgcgttgatgtacgtcatgagccgtttaacgccgaagacgtagtgattcttctcttcgagctcaatgatgtagtcccggatggcctgattctcctgctcatggacggtcactttacgatgtgtccacttgtagtaggctgctcttgagacgcccatcatccggcaagccttgctaataccgtagagcttgcctgcgtctgggttcacttcttgtgcaagttgttgaatggtctgatattgttcgtctgaccggcattccttctttccaattcctggagtttttttagtactgccgcctccgttgacacatggaccagtcgcgcttgtagtcgcttattttcgagcttcagacgctcgatctcagtcagttgcccattgtctttcttggccttgccacgccgatcttccaaggcagattcgccgccttgcttgaacttcttgacccaggcgtatacctgcccgtaggagatcttgaattgctgcatcgctgcgccgtagttgtagtcattggcaatggtccattgtgcaatctcgatacgttcaatctgtgtggttttgcgtccgtccttcattggtctggccctcccagtggtttgtaatggttgaccactagtatacagggaaacccaccgaacaataacgctattgtcggggataccatattctcgggctagtactgggtacgatgtatgccccgcaagatatttctgaacaatctctaatttgaactcctcagcatacttctgatgaacgcttctgggtttgaggccgtctacaccggttgcttcaaagcgttcaagccattgtcgaacctgattatgcctaacaccatattctcgctggacagcccaaggtgcccagccaccctcacgaaccagaccaatatagaataatttctcctccagcgtgtatctggaaccctttcggcccatataaaaactcctccctaggaagacaagctttaattatttgcttgtctacccaagaaggagtatatccgttgattcatagcggccgaaaggccgctctttttatgattcaagatcaattgagccgggggcaccgcatcacagttattctccgagcgttacggatcccttcgagtacctactatgactggttaaagtggcatcctaagtcacgaaatcgccgccgaattaagcttaaagagctggttcaggttctttggcaacgtcgaaaattttacggatacgtgcggattgctaaacgcattcgtaaattacttaaatgccgcttaagtgaccgcacgatttggaaagtcatgcgtgaattggggattcaatcgacaatgtatcgtaaacgctctaaaaagcctaccacaaccactgacatgccacaaaaacctaatttaatgcgacacctagctgacttgtctgaggtcgtgaccaccgatatcacctatattcagctgatcaaccaaaaatgggtttaccttgcaacagcgtatgatccaaaagcgagaaaagtcttagcttggcaagtgggccaacagatgacacaagacctcgcggtcgcaccgattcaagcgttaattcaccaaggttatacttttaagatggtgcatagcgatacgggtagtcaatataccagtcgtttatttgagacaacattgacagatgcgcacctgcgtcactcatattcgcgcaaaggcaaaccggctgataacgggcggatcgaagcctaccattcgctattgaaacgagaatgggtccggctggatcagatcaactatgaatcaattctagacgtcactgaatccattgctcgttacaacaccttctacaatcatgatcgcgagaccaacggtcgcggtgcttgcaaaagaaagtcagcagctgcataagtaacctttcaataggcgcacagccctggggaaagaccagatgccagggcttgtttgtagtgtctcttgcacgttaaacaagattaaacgctgataaaagatctgataatgcgtgaatttaagtgacaaccatacgcattcggcagaaccggacaatttttgtccggaccattgacattcttgccaattgccagtgcaaaggcagcaagaaaacgtgtgcatagctacatctggtatggtgttggtgcaagtagccagttgggattagaagcacttgaccgttatatgcctcgtatcaaagcgcagacaccaaagggaagcatcgttgctttggactacgaagatggtgcttctggcaatatggcagctaatacggatgccattttagctggcatgcggcgcattcgttcagaaggctacacgcccatgtattacagttacaagccatatacattggcacacgtcgattatcagcgtattctgaaagaatttcctaacagcctttggatagctgcttaccgtgattatctgccaactaccaaaccagactacggttattttccaagtatggatggggtagctatttggcagtacacgagtgcatttgggttgtcacaaggcctcgatggtaacattgatctgcttggtgtcaccgataatggatactcgaagcagccagtaacacctatcaccccagcaccaagcaaaccagcgcaatcaaccgcagccactgataccgattatgcgcaaactggtgttttcaagccttccacgactgttaacatccgcactggtgccggcaccggctatgcatccgttggtagctatgcacccggtgaaagtgtgatttatgatcacgtgtatatccgtggcacatatgtttgggcgcgttatctcagctactcaggcaggtatcattatgttgccttgggcgtaaatggtggtgagagctatggttcgcgcagttcaaatgcgcaaacctattcgcacacgtattatacagtccgctctggtgacagcttctggagcattgctaccaagtacggcattagcatgtacacgttagccgccaacaatggcaagtcaatctacagcctgatctatccgggcgagagcctgtacatcaggtaacaaaaaagtcctctgctcgcaaacgcgggtggagggcttatttttgttgctttgaagcacgggcataatgctgtaaaataagatacgtaagcaactaaatattttagtcagcctgtaataccttgtcgttctgcctcccttgctcagggaggcttatttttgtgcacagagttgacagaatcgactcaaaaaggcaaaaggtttacatatgccggattaggtaacttactatgagcaaattgtttgcatacccagcatagccatgcgatactgacggtgaaggagcaaaactccaatagctaggagtaaaaagctccttaggagttggcaagctaagctgctacccaccccaagaataatcgcgcatacggactgtatactgttaggaacctgcccccctcggcgggtcttccagataaaagcaattccttgccaactccgccccatcctatatggatggggtttgcgttttgattgcttttgtgcgctaaattatcagctacagcaaggccgttgaaacacgatttaataacttgcttctggatgcttctagatttgtcagtcaaaggggacaaaaaggggacaaggatacctcaaatgttgatacatagctatcagttatgcccggtggaggcattctttctggcagattgattgataagcgctcgcaaggagtttgtcacatgaaaacagtgttgctcgcaacgatccatcacccaaacatctccttaccacaactcaaacaaatcactgccgcaaccaccaaaatattttcggctgtgtatgtcacgattagtactgtgacttcgcctgaaatcacccagctattaactgaagagacagactttcactgccaagtcatcacaccgcatggcgcggccgatgctaggcgcaaggttcttgatttttgtttgcaggatgtcgactatcaggcaaatttgttttactgcgattttgataaggtgttgacggcaatgctgactgcgcggcagacgttgaaaatatttgtcgctcagctgcagttgactagcgggtattgcattattggccgaaatgctgaagtcatggcgagttatcctgcaacatggcgagaaactgaagctattacgaataaagccgcggccgtatttttttccttacctaatctggatatcacggcgggatgttgtgcctttagccaaaatgccgctagatatattgtggcgaattcgcatgaacggttgacagatacagaatggccggtgatttgtaaggcggcggggttgccaatcttagcggcgcgtgtcggctttttaccatttaatgagcagttaaacgctggccgcgatgatcatcattggcatggttatacagcgcggttggcgctcgcactgcaagctttgcagtcgctggagcaaggggacgtgatggcaaacaaaaacttgccgatcaaatctgtacaaataggctggccattcaatcttaaaggctaactagaagagcttctctgtaaaaaaaacgtcccgacacaaaaaatcgttgcaagcatgctcactgcaacgattttttggtgtctcattatttcttcgcagccgtcaatgcctgcgccagatcatcaatcaaatcctgctgatcttccaacccaatcgcaattcggacatgttgcggtgtcaggcctgaggtggaccgtttttcttcgggcagtttgaaccatggtaatttgactaaactggagacggtgccgagggagtcggcgaagtcgaagaccttggtgctgttgacgaacttgatggggtcaatgttgtcggctagtttgatggataggagaccgctggcaccggtggtttcttgttgggctaaggcatagccggggtcacttttgagaccggggtaataaacatgcgccacgtcgggatgttgttcaagaaattcagcaaccgcctgggcattgctggtttcccgatccagccggacagcgagcgtggcgatgccgcgacagacaagactacagtcgagcggtgcaagaatcgcgccgatggtattttgcaagaagccaatcttttcactgatttccagactggctgagaccactaagccagcgatgaggtcgccgtggccgctgatgtatttcgtggcgctatgcaggacgatgtcggcaccgagatcaagtggccgttgataataaggggtgaggaacgtgttatcgacgattgtgagcaggtcgtgggctttggcaagagcgctaatagccttgacgctgctgactttgagcagtggattggagaacgtctcgaagaaaatcgctttggtctcaggccgaatggctgctccaactgccgttagatcgcgcgggtcaaccggtgtgaaggtcaggccatgttgagcaaaatactgattgagcaaccgatctgttccactgtatagtgaatcaccgataataaagtggctgccatccgggaaaatcgcgagaaccgtcgcaatcgctgcaaccccgctggaaaaggcaaaccctgcatcgccattctcgagagtagcgatttgacgttcaagatagtcgcgggttggattgctgctgcgggcatagtcccaatcgctagtgccaccatcaggcgcaaagcggtacatggcgctttgataaactggcggtacgatcgcaccagctttatccgtttgcaattgtggaccatgaactagtttggtattgaattgggtcatatgcccgacctcctcatatgattggttgacaacttatgtcgcgtcacggcctacatatagtcgcgacttttagccaatagttaatgggtaacgcaaagcgattatttagtggttaaatcagcgccaaagtatttctcagacaatttctttaaagtgccatcgcttctaagctcctgaatgcccttggataaggctttctgcaagttaggcgatttcttactgatcattccagccacttcgtcaggcttcacatcgctatctttaagtgtctggctctttaaaccggttgtggaattgctcttagcgtaggcataccaggcggcggtggcgttgatggtgccatctgcgcgattttccttaaccagatttagcgaaacagtgaagtcgccagaaggtgtaatgttggcaccgtattttttagctaggacagcatttggggtgccagtgccttcaacaaaagtcttgcctttgatgtcgttcaaacccttaatcgaggtttcatcgctgcgagtgatcaaagcatatcgggagtacatgtacggtgtggtgaagttgtaaactttcttacgctggggtgttgcactgatgttattgagcacgaggtcgaacttttgacttccaaggccagcgatcagggaatcccattgggtaggaacaaacttggctttgacgccgactttcttggctagagccttgccaagatcgacttcgaagccttgcagcttgccatctttgcgataagagaagggcgcataagtgccttcgaggccgatggtcaactcatttttattgataagttcgctcgtgaccgtgcttgttttactgctgtcagctttactgctagagcaagctgtcaaaacgaacgcggaaagggcaacaattggtaataagacccacaactttttctttaacattagaatcttccttccataatggtgtttttagttacagctgcgttgtctgcacattgctggtatagcgtgacgtgactttttcaagatagcgctgtccccaagttaagacggtgcagacaacggcataaagcaaagcgaccagtgaatacatcaataatggctgatagttctcagcagcgatctgctgactcacctgaaacatttcgacgatagtgatcgaagccgccagtgaggtgtccttgacgagactgataaaactgtttgatagtggcgggacggccgtgcgtagtgcttgcggaatgataatttcacgcagaaccaagcgccgcggcaagccgactgagtaggcagcctcccattgaccgtgatcaatcgacagcagcgccgctcgaattgtttcagcacaataagcccccgtgttcaacgaaaacgtgatgatgcccgcaatcacaggatcgagtttgataccgtgaggaaaaatgcccggaatgatcagacttggtagcccaaagaagacaatgaacaactgcaccagcaacggggttgagcggaaaagccaaacataaaatgaggcgaagccttttgcaaaggtgatccaaaagccttttcgtaccgagatgcgcgtcagtgccgtgatcaatgcaatgatgaggccaatcgcgaatgaaactagcgcgattgggatcgtgtatttgattcccgcagccgccatttgtggaacggcatcggcaacaattttccacatactttttcctccttgaatcgactcacacaggcgtgataggttgattgaagtgggttgcgcgcgtccctgattgtgctcagaaatgcgatcacaggcgtagaaacctgcgcataaacgtgccgtgatcgctctacaaaaaaatccgcccaagtctattgtgacaatagacaaggacggattttccgcgttaccaccttgattaaccgatcgaaatcgattctctctaagtacttcgcaagtttgcgttataccctgactcagtaacgggagtgcccgtcagttgcttgcaagatgtgttcgcaactgaatgcttcaaaagaccatctttgccagtgcctgatcattgtctttcaccaaatgacaactcgctgcggaccttcgactggttactcatcttttcgcctgtgtgatattgacatcacattaggctaaaaaacgattgttgtcaatagtgagtgtagaaggtttctaaccgcgcctgcttacgctctccgcctaaagtccagtgactttccaaaataagtgcggtatatttaacgcggagtgaataattgaaacgctttaaggcttcaaggagggcaatatgaaaaaagcatgggtatacgggttagctgccatgcttggcttgggtgtatcagcggtgattgctaatcaggcatcagcttccgcagcaacagtgccgattgtgattcaatcagcgacatcgaaatgcgacactggttctgcgccggatcatggggcatcacaatcagcgatcgtaccaccgcttgctgacaacaaggttgaagtaccaattgtcacggtttcaagcgatgatgatcaaaaggcgggcaataccagcagtgcggatagttcatcggtttcatcgagtcagcaaaatggggcagcaacatcggacacaggtgcggaaactgtgggcagtcaagcacctgtcacaaacgggaatgttacatcgtcagcaaccgcgcagcaagatgatcgtgatgcacacccgtcagtttctgaaccaatgattaaaacggcacaagaagttaatgcgacagaagcaagctcgtctaaagcaccgacgagtaaagagcgggatgaacaggcaattgttgctgcagcgcaagcggcaacacatgataatgtgaaatctggccacacaatatctgtggtcccggagagtgtgacttcttttatcggttcaacccataagcagccgcagaatgcttttgagattatttggcaggcgttgattgagactgttcagatgcgacagcaatgcccaacaaatctgattgatgatttggttttgggaatgccgcaaccaaattttgacgttgtgcaatcgacatttatcgcaacgaaaagggaactcagcaagacgttttcttcgcctgtttttgggaagtcccttcaactagatagcctgtcgccgttcaatcaggtttttggcaagatgatcaacttgatcgatcaagtgttgttgacacatcttgttttcccagattaacttacttaaacagttccgtgatggtgaatgaaaggcgactaaatttgtcaacgggttcttcttagtcagaggggagcccgttttttgatggcactgacacgttttttgaatggccccaaaacttgatgaccgtaaaaaaagcctatctcttcagtattcgttacaaacacgaagaggcatagacttttcagaaataacagctgatcaagcggtatgcgcgattgtcaggcatttccggcttttgggttgatcggctgttgttttggtcgcttttaattttcttcggcacctaatttggcgacagcaacggcttttcgaactttgaccgcgtgtgccacgaggccgacagccagaccaataccagccggaactaaccagccaaggcccatgccagcaaacggcaggaaatgtaattggaaactgtgcaatgccagaccaagcgcactttgactgacaaaggctggaaaggcagcgaacatgtcgagaacggctgggactgcagtgaagccgacgacgaaccgatacaccagtggatcatgatggaatgctttgccgaaaacggaaaggagaatcaataccattgagaaaggatagaggaacatcagcatcgggacagaccaagcgatgatttgctccaaaccaaagttcgccgttaagaaggatagaaaactggtcagtgccaaccagacacgataactgacctttggaaaatgacggtggaaatcttgcgcaaatgcagcaaccaagccaactgcagtggtgaggcaggtcaacgtcaacaatgttgccagaaccgcatgaccagcagcgccgaagtaataggttacaacttggttaaaagcagtcccaccttcagggctaagtttgaagtgagccaatgacatgctgccgagcaggattaaggcaacatagatcagaccaatccagctagttgccatcacgcctgctttggcggtcgacttggccacatcgtcatcattttttaagccgagaccgcgaacagctgtgaccacggtaacgccaaaggctaaggcagccaaagcatccatcgtgttgtacccttgaaggaaaccattcatgaagctggcatttttataagctgctgtgacagtttgggttgctggatttcccattggatgggagaaaccaataaagaagacgaagaatagcaagacaaggaaaactggattgagaattttgccaacagccgttgtgattttgcgttccttgtaggataggaaaaaggcggcggcaaagaataaggccgagaagaccagcagaccaacctgcgcccacgcttttggcagcatcggcaagacgccggttgtaaaggacacggttgcggtccgcggtgtaccgaacatcgggccaatggtagcgtgaattaaaaccatgaaagcaagagcgaaaaagcggccaagtggacgaccaatatcatacacaccttctgcatgcgtagcggcaatcgccaacacaccgagcagcggcaatgcaaccgctgtgactaagaagccaagcattgctggaaaccagttggcaccagcgagttgaccgaggtgcagtggaaaaattaaattgccagcgccgaagaagagaccgaacaaaagtgatgcaatgacgacataatcgcgggttttgagcttcttttcagataattccatttgagttcctccagtgtttttagatgtatcattgattcattaatttggcagctaatgtggctaatgtcagattccaattgcatcacatccttcaatggtttgagttacatgtttgctaggcgaaaattcaagcttggggaagcgcttctgctcgcgctccgctataacgcgctcgccagcccagaaacctgcgtgtaaggaccttggtcgcaatggccaaagtgcggccatcacgcccaaggccgcttacactccggtttctaatcgggctggctcgcgctcacacaaaaaaagtcgctcttagatttttctaagggcgactttgcgcggtaccaccttaattcaccaaagccagctgcgccttggtcttcatcgcatacggtccaatgacgatatgctagcactgtaatgggtgcccccatgacacgttactgaagttcggtgtcctgcttgaaagggatattcgccatatcatgaatgcttcctcacaccaaccgaagctcgctgtattcacagacacgggtacttgtctttcgcgttgcatttatatttgatttttagtttagcatggattgttttcttgtcaataactaattgaaatttaatcaaaaaaagcttttgtccgatttgcgtaaaaaatggcacaagaagttttcttcacaatgttgaagctgattgaataaataaacttatttgataaatcaacattagctgaaacctgcaagcctatcgagttaattatattgatcattattgggtcagttaacgagtttttaagaaaaatgattttttaattttaaatatgacttgaatggaaagcgcagagtgattaaagcaaaaatgtgaaaccgctaacaatcactatataaataactaagtaaattacaagtgctaatgtggtgcataaagagctatttatatgccataatactatcagtaggagaagattgaaggcgagtcatagacaaaacccgatattaaagggatctgcgccagctctaattcattgattcttctcgctcaatcctgtattatgagtagtatagagagagataaatgaatttcaataacaatatggaggcaaaaagtgatgaaaaaagttaactatattgcagccggaatttccgcattaacaattgctgggctcctgttgccaactggtcaggttttcgctgctgatattaacaaaacatctgtagctgaagttaacattcagggtggaccaattaccttagatcaagtgcccgatctaaactttggaactattgagattgataagttaattgctggtgaggttagccaaccgcttgttgataataccgttccagttggtcccgtgaaaactgccgctgatcccaaggacggtaatgcaaccggtgatttaagcgtcaccgataaccgcggtacgaacgttggttgggagctgacagcgcaacttggcgatatgaaaaatgcaggtggtaaggcattggcgggttcaatgatccttaaagggaccgatattaagactgataatgtaagccttaatgcgattaacccaggcgccgctcttccagaattagtcattggcggcgctgcagtgtctgtctggaaagctgatgctgccactggcacagacgatggtcagggacaggggaaaaacactgctgtcatcaaaaatgcgggtggcacgacccttaaactgaaacagaatttgacaccaacagcaggacaataccaagcggccatcacctggactttagccgacgcacctaagtaatctatggcacctaaactaaggggcagcggtcattcgctgcccttttcatgactgtgggggcggaaccatgaaaaagaaaatcattttcagcctgttggcaattctgagcttgttgtggttcggcggtgcccatcaggttcaggcagctgaaggcgctggctttactatcagcccggcgttgccgcaaaatcaaattgatcaatcgacctattttaatttgctggtaaaacccggcgagacccagcggctgttgatttatgttaagaacacaacaaaaagtgctaaaaagttgaaggtcagtgcggtcagtgcgttcactcaaagtaatggtacgttaggctattacccaaataaacacacagacaagtccgctgagtacactttttccgggctgacggaagcgcctaaaacaattgatgttggtgctgaggcacaagtgccagtcacgtttgatgtgaagattcctgaaaagggtttcaccggtcaaattctcggcagtttatacgttgaagatcccacggtgcataaaagcggcggcagtggcatggcgattaacaacaagttcgccatgcttgtcggagttgttttgcagacttcggagaccaaggtggcaccagagctgaagttgatggatgtcaaaccgggcactcaggataatcaggccagcgtcttagccaccattcagaatatcaaacctcgtttatttggtgagatgacacttgatggcaaagtttatcggcaaggctcaaaagatccttacctgacacgttcggaaaaagggtggtcatttgccccaaactcgcattttgactacgccattttctccaaagaggcactggcaccgggcacctatacgcttgatttaacagtcaaaggtgctgacaaaacttggcattggcgccggaactttacgattacgcagcagcaggcggatgtcattgaagaaaaactgggacgtgccccacaaaccccttggctatggatcatcattgcgatcatactggcgcttgtgatcttaatcctactatggctgatttggcgccaacgacgcaaaaggagggagaccgatgagacgaaacaagcctagtttttggatcatgctgctcatgacaatgagtctcatggtcggcgttggcgcgaaggctcagcaagttcaggcagacacttctgttgcacaagttgaacttgttggtgaacttccgtcaacgaaccctgatcctaacccaacgccaacccctgatccgacaccaacgccagaaccggttgatcatcaaaccactgatcagcatggtcaagccacgccgctaacccatacaggctatctgccgcaaaccggcaatgctgttcaactttggtacgtggtcattggggttgaacttctgattattgtcattttaggcatcgtgttactacgcggccgatcacggcagggaggtaaaaaatgaaaaagaaaacctttatcatgatttgcctcacggtgatcttcggcatggtgcttggtccgctgcagtcagtggctgcagcggaggcaacttggccgagtgggatttatccgccacctgcaacaggaagttttacaagtcttaatggtgtttttgacagagtctcgacagattctagtatgattatgaacggcgctgatgaagtgggaattgaattgaatcctgatgccaccaatcaagccggttcaatgtggagcaaaaatccgatcgttgatttgacgaaaagctttaagcttgaaatgcccatgttcttcggtaacaacacgatcagtggcgcagacggaatgacctttgccttagcaggaacacgaccatctgcaaagggaaacagcggtccatctcttggagcgtggggcggacaaggcggcacgggcttgaaacccgaaagtattgcggcacaaggcttacaaaacagttttgtggtcgcaattgacacgcataaggatgatatggatcaaaatgcggactatccaggattaaacccaaatcaacaatatattggttctggttatcctggtcaagccagcatgtacgccattggatttcccttgtataaaacacagttgaagttcacacccacaactcaagaacctttgcaaaagttttctgataatatcaaggacaatgtctctaataatctttggcataacttaacagtttcgtggacttccagtccaacaggcggaacacttaattatcagttaacgtatagatctggtagtgggagcaagacgaccccttcccggtccatcacttggacgaaagatcaaattaagcaaatttttggaaccgataaagtttatctaggattcactagtgggacaaattctggtttggtgcttaaatataaggagccacatgttttaggaatcaagagtcttgctgatttcaacacggtaaagggcacagttactttaaagcgtggcaatgacaacgtgaccgaaacaacgcgattaaatatcggtgataagctcacttatgattatgcattagacattaacaatctcgatggtcggccatggcctgccacaaagattgtcctaccaaagggagaacatcttgaatacctgaaggaagatggaactgcagccaaagctggtgatacgttgaagattcaggctatgattggttcaacgactcaaatggtggatgcagttgtacaaagtgataatctttcggcagttattagcagtgataaactggtgttgccaaaaaacaccgattcaattgttaagtttagtttgccagctcaagtagcttctcacgaccttgtatctgatcaagcggtgacggatggcgcgggaacgctcactggtggaacaccagtcaaggattacaaactgattaatgccgttgatcaaacaaataatgttaagtatgtcattgccgcgaatccaggcgaactaactttagagaaggttccgggattttactttgaaaaacttggagtcagcggtttagaggatccaacagttggcgacgtgatcaatggtatccccggacaaaatccatttcccgcaacttcagccggaatagatcccacccaatggctgaatacactggggcggaagacgccagcaggctatgatggattcataagtgtcaaagactcacggccaaccaaaccggggtggactttaagcatgaaattatcaccgttcacaagaacagaaggcggttatgttctcggtgataacgggaatacggatggcggcaaggcccaaatagtgctcatagacaccaatcctcaagcacagctcaaagttgccagcatcaaagacaatggtaacgatactgtcgtcaaaagtatgccagctggtaatagcgactgggatctaaaggacgactcatcaaccgcaccgatcacacaagcattgatgtcaattgaaaaaacgccttctgtacatggaggcaagtatagctctactgcaacatggacgttagcaaacgctccgcagtaatagcaagctaggctgacaaataaattccaggatcccttgaaatgaaacactcatgagaatatgatgtgcttatctcttagattaaaggcaagtcagtcatgagcacagacaaaggggtcttaagatgaagaagaatcggatggtttcgcacatactcatcaccatggcggtagcggttttggccgtgatttccgagatgccaattcatgttttgatcgccggattcagcagattaggctaatgccattaacaggtgtcagttgaccgtttaatgagctatacaaggaagtcgcttcttttcggagaagcggctttttgatttgcccagaataaagttgcgagtgtgaagatcgtccaagtagcaaaggaaaggaaaattgcttgccatggtcaatctttcgtggctagatcaaatgtttcagtgcaaactagaagttttataagcctgaaaaactgtaaaaaagtagcatactatcctaaaacgcccatgaggtcaaaaaatcatattattaattcgaattattgattaaaggctgataatgcgggacttgcaatcgtgatttataagtttaataaatggccatttttgagatggagccaccgtttgaaaatttattatcactgtgtaaataacgagtaattattaatttggatcatctgttatgttggaacgcatagcatatctaacgaaacggaaatgagaaaaataacgttgaatacgtttacttaatagagaattatggttatatgcggactatatagttgatatataaaaaatattcgtatactattagtattgtaataagtaattaaaacatattttaaaaacaggaggataaaataatgaaaagagttaactacatgtctgctggtttaatagcaatgacacttgcaggggtcatgctgccaatcacaagtgtctttgccgcagacgaaccaatcaagaaaacctctgttggtgaagttcgagttggggttgatccagataatcctgatcctaacaatccggacaatcctgatgggtctaaggatattttgtcattggtcaaggtgccagatctgaagttcaagagtgtcagtgttgagcaactggcaactgggcagcaaacattgccgctcacaagcaacacagttactgacaaaccggttaagaacgaaccagcaggaaatgccagcgatgggaataatcaaggtttgttaaatatcactgattatcgcggcaccggtgccggttggaagttggaagctcaggcgggcgaactcaagaatgcggctggacaaaaactggctggtagtcttttgctagctggggttgcgaaaaccgacgagactgataataatccaactgctattagtcaggctgagttggtcttggaaggcagcggggtgcaggtatggaatgccgcaagtggtcaaggccaaggccgcaacacaggtgtctttacttcggcagataccgtgttgaaactatctcaaaacacggctgcatacggtggcaagtatcaaacggctatcacttggacgctgaccaacgcaccgtcttaatggatcgcatatcaccagaaagggggcagcgatcgcacgctgacccctttttgaagaaacgcgctttgaatcgactacgggtgctgcgctgctactgggttgatcagatgaagttttcggaatggcaaatgtagggaaaagggggagaccgatgacacgaattatatggcgctttttgatcagtttgatcattgtgttcggcgtcctcggtgaagggatcatggccgctcaccaagtgcgagcggcgacctccatcggtgaagtcgtcgtgattgacgatcggccaaaacccgacaaggatcataatgcaccaggaacagaagtatcaaaaccaaaggaagagccttcggtaccgccacgccaacaggttgatcgtttgccacagaccagcgaaggaggacaaacctggtatccgctgatcggttttgcactcctgatgatgagcagtttgcgtcttcaactgcggtttaaacgaaaagacaggggggacgatgatgaaaatcgtgactaatttcgccatcgcttttgtcaccctgatgcttgcaggtttcgtcgggccgtaccagtcggttatggccgcagatgatctaggccccaaaaagtctagtgctcaattgacggttgatgctggcaatatcatgattcagcaggtgccggatttgaattttggcggcatttctgttcatgaaatcgtgagtgggtcctttcaacggcatccgttgaaaagcaatctggtgaatcctggaccgattaagacggcaacgaatgccaatgacggcaatgcgactggcctattacaaattgctgattatcggggcactggggctgggtggcggcttgaagcaaaaatggacgcgatgacggatggcaaagggcatttcttagcggggtatgttgatttggttgggtcacagcttgccacgagtaatcccgatatcaacccgattaatcctgccggcagcaatgtgccgcggctgaattttgccaaagacaacacctctgtgagttcaactgttgtttggcaggccgatgctgagacgggtactaagtcaggacaaggacaaggcaataaccagaccacaattggtaccggaacggcattgacgttagttgcaacgaacaccaacgtcactattgccaaaggcaggtatcaaggcgctattacttggaccctgagcaatgcaccaaaaggttaggccatggtaaggattaacttttggaggagccagaagtgagatgggtggacatggttgcttgctgaggtctgtagcgaaaaaatacggtgcaattgaacttcaagtgcgatggcacctgcaaccggactacttgcgaaaggaggcgttctgatgaaaaaacgatgctatctgttagcttgtctcggcatgctgttgtgtaccctgctggcgcctgtgacgagtgttggcgcggccgtcacgtggccgacgacttccggctatccagcaccgccgtcatttggtgacgtggacggcctcttttcaccaacgatgggtgactcaagtttattgacggatccgaccagcggacatgcagtcgggcttgagattaacaaggatcaagcaaatcggtcgggagcaatttggagcaaggcaccaatgtttgatttggataaggatagttcgtatacgatgtacttttatttaggcaataagacagttaccggtgaggggatggcatttgtccttgctgctaaaccagctgcgccgacacgggttgatcctggttcactgggtgtttggggagttgatcgtctttctcctaatagtactgccaagcaaattgccgacacagcgctgcctaacagttttgcaatggttgtggataccataaaaaatggtggggacgcggctggtggttatgatcaatatagtgcctacctcgattattactttggtagcgggtatccggcacaaacggctatgtatcgcatttcaaatccatactggatgtcgtggttgtattttaatggtgatccgccatttggagggtttcaaacaggtttaggcttgcaaaatacactttcaaaaacggcggctaacggtaaatggcatcagttgacattagactggaagaaagacaatgctggcggtggcaccttaacttacacagttacaatgcaaaaaagtactgggtcaccttatcagtttgaccgaaagattaaatggtctaaaagcgatattcaaaaatacttcgcccaaaaatcaggcgatcctgttccgcgaaaactgtatctaggctttaccggtaccacgagcagtcaatatgaaccgcatgtggtcgcgatcggcgcgatgccggaagcaacggccatcaatggcacagttgctctgatgcgcggagccgaaacggtggaagcaacaactcatctaaaagtggacgatgtactgcactatgattacaccgtgaacgtgaaggcaaccagtcaggcaccctggccggaaagcgggacagcaacgatgaacgtgccaaaaggaaaatattttgactatctgaaggctgatgggacgcccgccaaaccgggcgatacgttgcccatcaaagtcacgataggtaattcggattatcaggcccaaggaaaagttcaaccggatggcaatcagattgctgtcaccaatatgccccagattccaaaaggagcaacggcaacggtgaagttttcactgccggccaaagtcaaacatcatggcctgctggaaacgacaccggttcaggacaaaccaattgggaccatcacaggggatggccagacttatgatctgaagacacctgcgggcaaagattttctcgcttatattcttgatcccgaaacaggtgaactcgtgctggagaaagtgccgagttttgtcttcgaattgaagaatgggcaaaccggttatcgtaatccgaccgttatggagatggtaaagggactgccaacgccaacgaccactaattgggatcaggcgaatgcagatcagtggctgacgaatcagcaaggccgcgaaccgaccaattcgacaggcaaggtgttgagcgtgaaagatacgcggccaaccaagcaaggctggcatttgacgatgcaactatcgccttttacattaactgataatagctatgtgctaggcgataatgggaacaaattaggcggcaaggcaaggttggttctgacagatcagacaacgcaaattgcagctatcaaggataataacaacgcgacaccggtgaaaaatatggcggctggtgggacagattggtcgctaggcactcaaaccggtaatgtagcggcctacctaggcattgaaccaacagcgactgctaaggctggccaatatcaggccacggctacttggctgttgacgaatgcgccgaaatagtaagttgcttgagaaacaacaaaaatggttctgaaacataagactgacttatgtttcggaaccattttttattggctatgatttagttttctgtgaaaattgccgagttaatcgttgctgaacgtggtgaattttgttaaacggcaatgcttgaaggagtgtgttcaaaatgattaagatgccgcctagccactcggccggtccgaacgcgatgtgcaagcgggtgacggctagagtggtggcagtcaacggttcgaaggcactcaacatgcccgtggcgactggcgagatgtagttgaggctgcccaacaccagcaagtaagcgaacatcgtaccgaatacgatcacgaaggcaatggcaccaaaatcaggtaaagttagtagcggattgggatgcagcacgtattgcggtaaaaatggcaagctccccaagagcatggaccaaccggtgaccgctcgagcgtcatatttggccagtaacgtgcgcggaagcaacgtgtatagcgcctgactgacacctgccataatgccccagaaaacagcggccggcgcaagacttaaccctgtcagatgaccgcgggtaaccagcaaataggtgccaattagcgctaaagtgatactgacaaagtcaattcgccgcggcatctggtgagttgcaaatgccacataaagcaagatgaaaaccggcccaaggaactgcaaaatcgttgctgttgcagcattacctgcattaatcgctaaaaagtaggttagttgtgacggtaccatgcccaaaaaggcgaacacgatcattagtatagcatcgtggcggtttttccaaattgcaaggaacatccgcggttcttgcacgccgctccaaagcaaaagtaggagaccagcgaaaaacaagcgaatgccaaccagccacagcggctttactcccgcatcggtaaatagtgtttgagtgaaaataccgctggcaccccaaaaaatagccccaataacggcgaaagaaacaccttttagtttttggttggtatggcgagcgagatgagcttcagtgcgtggcatggcgggatcctttcgaagtaagactgtccaagccattctacgcaaaaaaactagggttggctagttcgtgcaatatcgatcaagcttcctgatggtgtgtcttgaagttgcgatgcaagtgcctaaaaagaggcagccattcattgaagaataactgcctttttgacctattcctgagtcgtcttaatttttaattcgtagcgcaggttggttcgatagaaatgcccaagcagcatgcctagcgttaatcctaagacaatgagaccgagcgggaaaagccaaccaccgaggaacccgccgatgccgatcacaatcatggcgatgatgacgccaaaaaagatactagcaaagccaagtgcgccaccactaaagttagcattagctgaatacacactagcaaatggaaattgactgccaaccagcggccatcccatcattaacgtcatgccataggtgaaaatgattacggcaatgccggccaataaggcatcaaagccgccaagcgcagtggtcaaaatggtaatgaacaatagcggtggtaagaataatcgggcgaacatggccttgactaccccgcgcagtagcaagccgtgggtcgtaaaaggcacatactggaaaattgccatggcttgaggttgactcgaaaaccgcagattaaccaaagcgggagccaacgccacaatgacaccgatgccagcgtaggcaataaaatgcttcgccgagctaaatggcatgtcgcgcagtccaccgccaacaaagatcagcggtagaataatgccataagccaactgcggatagacccgcagtttataatcgcgttcgctgcctagcacacgccaccctaaagtgaaatatgtccgttcttcaccaggacgagtcagcagggcactcacgccgcggaaccaccaaccaagtttacgcgtgcgggcatcgccttggttcaatttttctagataggcttcaaacacaccagaaaaatgtagaaagacgagggtcaaggcgatcgggacgacgacacttaacgcggtgagcgtcagacttaataccgttacctgtcctgcaaacaacatgggcagaccaacgaaccaagcggggacagctggtaagaaaagccaattaaactgaccgctgatggacatgccgaaaagcgacatggaacgcggcagcaagttaggcagctgaccaccaacgtagataccaatcatcagtaagatctgcactaaattcagcatgttgcgcaatcgttcgccatcaaaaaagcgcaagactagcaagtaaacaaaaagcgccatgaccagacttaacacgccgctcagcagcaaaccgatgagaccgccaagtgccacgattgggccataatggataccggccatgacgagtccaggcccgcccattgccagcaacgtcatgcccagatagaagcaaatattgatcaaccgcgcaaaacttaacgtttgatcattgacgcctcgggaggcaaaaacactccggtcacgcgggtcaagaatcaggcttgagtaagtggtcaaaatagcgagaaaactcgtaagtagttgaatcgtcatgaaaagggtaaaggtcgtgagaattgaggtcgggagaaacataagcagccctaaaatcaggccaaagaagagattccataaaaaggcggttttgatgctcgcatcttgaccacgtttgcgtttattgaacatactgcctaagccgctagattcacgagcggccaagagacccttagtcgcaaggattagccgcaattgatcaaactgaataccacgtttttccaataagggcctaaagcgcgcgagccatgcaaatgctttcggcaaaggcaacgcggctgtatcagttggatcagcggtgtctagggacgtctttttaaatagtttcatgggattcaccgccagtcacgatatccacgaaactttgtgccttttgaccgtgttcggcaaagccggttagatcgttgaagagctgttgcaggttggtgtcggcttccttggcaatggacttgaaggggccgtcagcaacaaccataccgtcatttagcacgatgatgcggtctgacaacttctgaacaacatcgagaatatggctggaataaaaaatggttttaccacgatcccgcaaatcctgtagcacttcttcaatgacaagcacggtgttggcatccaggccgtttaacggctcgtcccaaaaaagaatgtcgggattgtgtagcaggctggcgataatcaaaatcagttggcgcatcccctttgaatatgatgaaatgcgccgatcaaaagcctcccgcaaattcacaagatccgccagtgcaaaggccttttgttcagcatcggcagcgctgagtccgtaaagttggccaatcaagcttaaatattcacgagcagtcaaggcgtcaaacacgtcggcactttcaggcacatagccaatccgccgtttataactcgggtcgttgggtttgattggctgaccaaacagctcaatggtgccgccgtctggttgcatcaaaccgagcatcattttaactgtcgtgcttttccctgcgccattaggaccgatgtaaccaacaatgcttcctggagtaatcgtaaagttgagatcttttaaaacctccttggatccgaaacttttctggatgtggctgagtgttacgattggttctgccatgataggcctcctcttgtagggttgagtaggtacgcgtctaaaaaggtgtcagcaagaaatgaaacgcgcttgtctgcatacttctttgggccgattatgacagaaaagattattgttgtatagagaaacaacttttgaataacgctttttggcgacaataaaaaacatcacgagagacaacgtgatgttaagaggttcgctaatttaatggactaggccaaacgagagccaaataaaaaacgaaaaatcggtcagtttgtgaaccgacgaaagagtggccgaagaataaaatataatactggtacgataatggccgttgcaattgaattgatcacggtggcaggcaaactcaggaaggcaccgaccacggctgccttgaaaacgctaccgaccatgagcgcctcaacaaccccagtgagataagaagtgacgatttttgtcaggcctgcgagaataccaattatgatgatattgcgcggttgatcgttatgcttaaaggctttgaccaaagcgctgacaacgatggccatcacaatggcttcaagggcagtcaaccatgaggtagccgcatagccgttcagcagatcaaacccgcccaaaccgatgacagcggccaaaccacctaagcggccacctaggaaaagaatggcaagcaccattaaaggattaccaaagtggatgaatggccgaccaaccattgccggaattggaatccgtaagagtgaaatgccaatgaagataatggcagcaaatagaccggtgaaaataatattctttaacgtattatgggatgtttgcatcgtaatcgcctccaaaatattgatagtaatgcacggtatgtggcagtttatggcagttgtttgcttagcgcaggaatgacgccagtcagattcaggccgtactttggatcggcatcagtggcaagcgtggccttgatcgcaagccgggcggcaaccatgccagttgcggccgcttgccgcaagttttggccttttaacaaacccgtcgccaaggcagcagcaaaaagatcgccagtgccaaaataatggcccgtttcttttggctgagccaaggccagcgtggtaccggatgcatcgatgccgaccaccgcaatttgtttgtgaaaaggcacgccggtgatgagaacggcgctgtcaaattgggcatgcaggcgtttcgccaaagccgtgacggcagaaggatcggtgagcgttgttggcttttcatccaaaagcagctgagcttcggtgatgttgggcgtcaagacagttgcccgatgcgccaactgttgcatggtcgccacataagcagcatcaaatcccttgtaaagtttgccgttatctgccatgacgggatcgatcaacacgagcggggcatgaaatttaggcagccaacgatcccattggccggccgccttttgaccaagataaccaaggtaaatgccatcaggctgcagttgcagttgttgccagtgcttgagaatccccggcatttcggagctaagatcaagataagtattgacgcctagtccgccagtgtgactagacagcagtgcggtaggcaaaacatacggcgtcaaccccagcccagccgctaacggcagcgccacgctcatcgagacttgacccacaccacaaagatcttgactgatgatcagactttttgtgttcacagcacgaatcctttctgaaaagatagttgttaataatgagaatgcgcaattttaggtgtcttgtcaacaagagcgcgaacaggcacgtttagaaaccggagcataagtggcctcaaacaaaatggccccggcatcgggccgtgaccatttaatagaaagaatcaagctgaattaagcattccgaatcgtctgagtcgcagcagcaatgcgcttgacgacggttggattgtccatcgtgtagatatggatcccatcaacgccatgcaccagcaaatcgacaatttgatcaatcgcgtaggcaataccagcatcacgcatcgcttctttattgccagaaaaatgctgcatcattgcgacaaattttggtggcaagttgacaccggccatggtggccatccgttcgatctggtgttcattgatcactggcataatgccggcttcgataggcacgttgatcccggctaattgtgctcgttcgcgaaatcgataaaaaacctgattgtcgaagaaaagttgactgatcagttggcttgcgccggagtcgactttttctttgagatggtgaatatcactgaccacatcaggagattcaggatgcttttctggatagcaggctgctactacgttgaagtcgccgacttggtgaatgtgttcgatcagatcacaggcatagggaaaatcgttactaacgcggccgcttttgggtatgtcaccgcgtaaagcaaggatgttatcaatgccagcatcttgaaaaccgcgcagttctgcatctacctgttctcgggtgagttgagcggctggcagatgggccacgggttccatatcaaactcatctttaatcagtttggcaacttcgagtgtccccatgtgaggcttgttgccattggcgccgaaggttacggaaacgaagtcaggatcggcttctttgaccgcatcgagggtgttgagaatcggagtcaaagcaatattgctcgcatttttgcgcggggggaaaacttcaaatgagatgacttgatgatctttaaagcactggttgattttcatgagtgagttccttacgtacttgtttagccgctgccaccatgttgatgaggctggccttggtttctgggacatcacgagtcttgaggccacagtcaggattgatccaaacatgatcggcaggcagacgtttcagaatttcgtggatgatgtgcacaatttcgtcctttgaaggaatccgtggggaatggatgtcataaacaccaggaccaacatgagtctgaaaatgggttgccttaaggatgtccaagagactgaagtcggaacgggccgcttcaaacgagatgacatcggcatcgaggtcgtcaatcgccttgatgatatcaccgaactgcgaatagcacatatgggtgtgaatctgtgtttcaggcttgaccttgctgccgactaaccgaaaagctggtactgcccaatcgagatacttcgggtaccaatctttcttgcgcaacggcaagttttctcgcaaagccggttcgtcgatttggataatcttgatgccatgcttttcaagatcaagtacttcatcttccaaagccaatgcaatttgttcaacgctcgtcttttggctcagatcttcacgcgggaaggaccagttgtagatggtgactggaccggtgagcatccccttaacgaggtggtcggtttgactttgggcaaagacagtttcagcaacggtgattggcttggtgcgataaacatcaccccagataatgggtggtttcacaccgcgcgtaccataactttgcacccagccgttgtccgtgaagcggaaaccgccaaagttttcaccaaaatattcaaccatgtcatttcgttcgaattcaccatgaacaagaacatcaaggccgatttcctcttggaatctgatccattcgatttcttctttgtgattgaaggcggtgtattgttcttcagtgatttcatgccggcgaagttttgcccgattgcgtcgtacttcagcggtttgcgggaacgagccgatcgttgttgttggcaatagcggcagcttgaacgccttagcttgaatcgccaaccgggttttccgttccggcgtccgcgtgtagtcggccggagttaaggcagcaatcttttcattcaatgccttattttctgcgtaccggggcttgctgaacaaagcgacgttggcttgataggctttgtgatcagcatcggtttcgaagatagcatccaattcgtgcagttcactgagcttttcttcagcaaatgcgaggtattgtttttcctcaggctttaaatgagtttcattgcgtaaggtgtatggcacatgcaacaaggaggttgaggtgcttaacaccagcttatctgtgatctttgccagcgttttaatggttgctaaggtatcggcataatgtgtgcgccagatgttcttgccattaatgataccggcaaaaagagttgcgcctgcagggaagccttgcgttttcagaagatcaaggttggcatggccttcaacaaaatcaaggccaaaaccgtcaaatggcaacttactgatgcgatcaaatgagtcggtcaagtcgccaaaatacgtttggactaacactttggcgctttgcttttgagccagaagtggggtgtacagccgttcgaacaaggcgaggtcagcgtccgtctggtcatagaccaaggccggctcgtccacctgaatccactcagcaccagcagcatgcaagcgtccgataatgtcggtgtatgcagcaattaagtctgctacaaaatcatctggggtgacatcaatgaaccgtgacagctttagtaacgtgtatggaccaaccaaggtcgggcgcgcattgatacctaatgcttttgcttcttcaaactggtcaaatagttgccagtctgtcactttaatttgtgtgtcctgatcgaattcaggaaccagataatgatagttggtgttgaaccattttttcattgccaaagctttgacatcaccagcctcgccttgataaccgcgcgcctgggcaaaataggtgtccagcggcgacagacccagcgcttgatatcgctttggcacgatattcaacaagttggcaacatccaaggtgttatcgaagaaggaaaaatcgccagtcggaatctggttaatgctagccgcttgaacagtttcccaattatgctgccgcagggctttcacttgttcctgtaattcctgtgctgtgatttgatgtttgaaatacttctgggtcgcaaatttaagctcgcgatgttcgccaatgcgtgggtagccgatgattgttgttgtcataaagaaatcctcctcagttagtgagcgcgagccagaccggttgctggtctgacaaacgcgttatagcggaaatttagttgcggaaaggtgcggtgcttgtttgggttcacgaaagatgtttagcgagaaaatcgtgaatgtcaaaaaagccgccctcagcgcagacaaattgtctgcgccaaggacggcttaccgtggtaccaccttggtttgaaagccgttcacacgactttcctcaatcagtccgacagcaaatagctgtgagacctaacgcaataatgggcgtccccatgaccgcctcgcaatcgctcagcgttcctgcatcaccaagaccatattcgctgccgtttcttgatgtcctttcaccaaatggacactctctaagcaaaaaactaacaactactcatctttccgcatttcaatgttgaggctagtttactgacgaagcttgttattgtcaagaactttgttcgaagagcgtgagaagtagcggttagttcggcgtagcgaagtgcgactgcgaacccttttttcgcggcaacagcagacgatttaaacgcttgaactaaaagaagagaactggcggagcggcgatgggctcagcactgaaatttgtctaggcggagtggttttctccgcctagacaaaggccgagcttcaagaccgcgggttttgcgggcttgaagtcgtgcccagtgcgctagcttcgcggtcgccaccccgaatcgccgcgtagccaactcggcatagaaagctaaatgtaggctttgttgccctatgctccggcttctaagaggggtggctcacgctctgcttcgaaacgcgatcacaggcgcagaaacctgcacataaggacctcaagcacaatgaccaaagtgcggtcatcgcacttgctgccgcttatgctccggtttctaaacgcgcctgctcacgctcttaaacgcgatcaccaccccagaaacctgcgtgtaaggaccttggacgcaatggccaaagcccagccatcacgtccaaggccgcttacactccggtttctaagcggggtggctcacgctcttaaactttttcactgacttgttttccaaattgcggtaagctattaaaacaagttatagaaggagaaagacatcatgagggtattgtttccgtacatcaaaaaatatcggtgggacgtgatctggtcggttttggcgattttgattgtggcctttgcaacgttgtggcagccgcatttgttgcaggtaatcatgaatgccatcatgaaaaatgataagcagacagtctggattaatggtctgtatttgatcggactggcgatcatcgggattattggcgggatcgtcaacacgatttacgcggcgcgggttgcgctgggtgtggcaacggatttgcgtgcagacgaatatgctaagattcagagtttggcgtacgcggatgttgaaaagttttcgccatcgaacttggttgttcgaatgaccaacgatatcaatcaagttcagcaaatcatcatgggcttctttcaacaagtcacgcgaatcccgattttattcgttggcgcggtcattctcgcgatcatgacactgcccgaattgtggtgggttattgcggtgatgatgattttagtttttggcgtcagctttttctcgttcagtcatatgggcaaatactttggccggatgcaacaattaattgagcgcgtcaacacgttagcccgagaaaatctgatgggcatgcgcgtggtgaagtcgtttgttcaaggcgcgaatcagatcaagacatttgctgagtccagtgatgaaatgcgggatgtcagcgtcaagatcgggaacttgttcgccctactaatgccggcgttcttccttgtggctaatttagccatggctggtagtatttggctgatcggacaggacattactagtcatcctagcaatctggcggcaattacaagctttattaactatttgatgcagattctgtttgccattatcaatggtggcttcatgttgacatttgcttcacgtgcgttggtttcactcaaacgtattcaagaagtcatggacacaaagccgagtatgacattcgtctctggcccgcaccgtgacttagatggcgcggttgaatttgatgacgtgacgttcacctatcctggtgatgaaaagccaaccatttctgacatcagtttcaaggtgaaatctggtgaaatgatcggtattgttggcgcaactggtagtggtaaaaccacattggcacagttgattcccagactgtttgatccagataccgggattgtcaaggttggcggtcacgatgtccgtgctgtcaccgaagccgatttgcggaaaacggttggcttcgtcttgcagcgatcaacgcttttttccggtacaattgcggaaaacttgcagcaggggaatcctaacgtcaatctagatgcgatgcgctgggcggcaagaatagctcagtcggctgaatttattgaacgcttgccacgcacttacaacgccgaagttgaggagcgatcctctaacttttccggtggtcaaaagcagcgtctgtcaattacccgtggcgtgatcggccagccgaaaattttgattttggatgatgcgacctcggctttagatgcccattcagagaaattggttcaagaggcactggcacacgagctgggtgatacgacgacgattatcattgccgaaaagatcagttctatcatcaaggcagatcgtatcttagtgcttgatgaaggccgtttagtcggcagtggcacacatcatgatttagttcaacataacgatgtttaccgagagatctatgccacccaaaaggcattggaagagggggtgtgattaaatgaaagacttgaaaaatgcaggtaaattttatgcgcattatctgaaaccttattggattgagtttttgatcacgacgattttggttggcatctctacctgggcaattgtggtcgcaccgacttacatgggacgagcgatcgaagaactggcaacctatgtgcagcagtggatgaacccagcaactagggcacaagcaacatttacgacatttaaccataccttggcgattttcgtcttgctttacatcattgatgccactagcatccttatctcaagcttattgttgtctaaaatcagtggttactcgactggtaccatgcgggtcggattattccgaaaaatgcaacggatgaaagtgaattatttcgacagtcacagtgacggcgatattttatcgcggtttacaagtgatctggataatattttcaacgccatgaatcaggcgttgattgaaatcttcttaagcggtgcccagtttatcgggattatctggatgatgttcacccaaaatgcgacgttggcctggatcacaatggcatcgacacccgttgcaattgggctgtcggccttcgtcatgcatcaagcgagtgtctcggttgatcgccaacaagatgatattggccgcctaaacggttatatcaacgagcagattacaggccaaaaaatgttgatcactaatggcttgcaacaggaaagtgtcgccggtttccagccgtataatgcggcggtgcgtaagtccaacctgcgcggccagatctggagcggtattttaaatccattgttgatgggcttgtcattgttgaacaccgcgattgtcatttttgctggttcttggttggcactgaatggttctttgagtcaaggcgcggcgctggccttggtagttgtgttcgtcaattatgcgcagcagtattatcagccaattgtccagttgaccagtctattcaacatgattcagctggccatcactggcgcccgacggattactgaagtgcgggagcaacctgatgaagtggatccgccagaagggaaaacgcttgacggactcaagcatgagttactgatcgacaatgttcattttagctatatccctggcaaagaaattttgcatggcgtgaccatcaaggtggataagggcgaaatggttgccttggttggcccaaccggtagcggtaaaacaacggttatgaatttgctgaatcgcttctatgatgttgactcgggggcgattacatttgacggcgtcgacgttcgcgaattcaagctcgcctcattacgacaaaatgtcggtattgtcttgcaagacccgcaactcttttccggcacaattcgcgataatattcgcttcggcgatcccgatgctgatcaggcgcgggtggaagcagcggccaaacaggctaacatccacgatttcatcgtgagcttgccagaaggctacgatacctttgtttcagatgaacaaagtgttttctcggcaggacaaaagcagttgatgtcgattgcgcgaactattttgaccaatccgcggttgttaattctcgatgaggcgacaagtaatgttgataccgttacggaagccaaaattcaagcggcaatggataacgtcattcaagggcgaacgagttttgtcattgcccatcggttaaagaccattttgaatgccgacaaaatcgttgtcttgcgtgatggcaacatcattgaggaagggagtcatgagcaattactcgcgcaaaatggcttctatgccgagctttaccacaatcaaatggtgtttgaataacttgtaaaaagattccgaataaaatcggagtcttttttatttttattcgtttgtgaaacggttgcaatggcttcctagcctcaataatatatgttatcctttttatatcagaacaatgggtaggacggttctgataaatattgggatgatggaggtaacgaatgagtaagcgtagatatctggtcgctatcggcggcattttgcttcacctgatgattggttccgtgtatgcatggagtgttttcacgggaccgattgccaaacaaaccggttgggcgttgtcatcggtgacagttgcgtttagtatcgcgatcttcttcttggggatgagcgccgcctttatgggtcggctggttgagcgatttggtccgcgactgacagggacagttgcggcgttgctatatggctctggcattctgttgacaggactggcggtgcaacttgagtctttgccgttactttacattgggtatggtgttgttggtggtttgggattaggtgcgggttacgtgaccccggtttcaaccatcattgcttggtttccagacaagcgcgggctcgcaaccggcatggccattatgggcttcggttttgctgcgatgctgaccggtccgattgctcagaacttgattgctgggattggactggtgccaacgatgtatgtgctcggcaccgcatatttacttattatgctcacagcagcgcaggttatccggaagccgcgtccgggtgaggttcctgctgctgatattgctaaaagtgtcagtttgaccggtactgccatgacagccaaccaggcagtcaaaacgcgttcattccgctacctgtggctgatgtttttcatcaacattacctgtgggatcggactggttgctgttgcgtcaccgatggcgcaacagcaaaccggcatgtctgcggctacggcagcgatgatggtcggggtcgtaggtttgtttaacggttttggtcgactggcttgggcaacactctcggatctgattggccgtccgctgacgtacacactgatttttacggtggatgtcgctatgttggccggcattctggtgttcagctcaccattgctcttcgggatcgccttatgcctgatcatgtcctgctacggtgcagggttctctgtcattccggcctaccttggcgacgtttttggtacgaaacagttaggtgctattcacggctatgtcttgacggcgtgggcagttgctggagttgttggaccgaccctgcttagccttagcgatcaatacttccacagctatacttacagtttgattttcttcgttgcgcttgaattggttgcttttattctctcgattcgcattcgccggcagttcagcgttgtggctcgtgatgaaaaggtgacggattcactcgaaaggcaacattgattggctaatactgtgacagcctcgaaaaaggctgctcgtgatcaacgaatgaatggggaaattgacggttgtattggtctataacaatgaagtttataaatgaataagctctggaaaaatccatacagatgtatggattttttttgcacgctaaaatcccggtatatcaacattaatgattcataacgcgaagtatttaaaagcgtttaaacattattagttgacatacctgtacgtacaggtaaaataaagtttgcaagtgaaagcgatttctggaggagaaggcatgcggaagtatgatgtgatctatcaggatttgaaagataagatcgaggccgaaatttatacgactggttcattattgccgagcgagaatacgctgcaggatatgtatcaggcatcgcgcgacacggtacgtaaagctttgcggctgctcaaagatgatggcttcattcaatcgcagaaaggcagaggatcaatcgtgatcaatcgccaagaatatgtcttcccggtgtcaggtgtcgtcagttatgccgaattggctaagcagcttcacttgcagacaagaaccgtggtgttggccaatcattttgccgcacttccggccaagtcctttaaagatgttgatccggatgttgaagtcaagcagatgcgtttgctgaagcgagtgcgttacttggaaaaagagccggatatcattgatatcgattatttggatccaagagtcgtgccgccgattccggagtcggtggcaagggattcgttgtatgcgtatctcgaaggacaaattggcttggaaattgcttatgccacaaaagagattacggttgaaacggcaactgaagaagatcgtcgttatctaaatcttcctgagggcgccatggttgtagttgttcgcagttgcagtagtttggcagacactagaaaatttcaatacacagagtcacggcaccgggcagatcgcttcaagttccacgacttcgcccggcgtacaagaccatagagcgtgagcaggtttctgcgcctacgaacgcgtttcaagcatagcgtgatctgatatgttgagactcaaaatttaagtggttttgaaagcctttgtgtttaggtctcaagctcagcaaacgcttttcaggaaagggagtcaccatgggatttcataataaagtcatttatcagctataccccaagtctttttatgacagcaatggcgatggggttggcgatctgcgcggcattatcgacaagatcgattacctcaagtcattacatgtcgacatgatttggtttaatccattttttgtttcaccgcagtatgacaatggttatgacgtcgcagattatcgtcaaattgatccacgctttgggaccatggccgattttgacgagttggccaaaaaacttaaagcggcaggtatcgacatcatgctggacatggtgctgaaccataccagcacagagcatgcttggtttcaaaaggctttagcaggtgacaaacattatcaggcatactattacattcgaccaccaaagccggatggcagtttgccaacaaattgggaaagcaagtttggcggcccagcttgggcaccgtttggcgatacaggcaattattatttgcatttatatgaacggcgccaagcagatttgaattggcacaatccagcggttcgacaagaagctgctgccattatcaatttttggcgagcaaaaggtgtccatggttttcggttcgatgttctcaatgttattggtaaagccgataagcttgttgatgcaccgccaagtgtggccagcaaaacgttgtataccgatacaccgattgttcaggactatttgaaggagctggcagcaaacagcttcggtcaagatgataatcgtgtgacggttggcgaaatgagttccaccacaattgtcaattcgattgcttataccaaaccggacaaccatgaactttcaatggtttttcaattccatcatcttaaaacagactacaagaacggtgaaaagtggagcaaggtgccatatgatttcaacgccttgcgcgatattctccacacttggggtcagggacttgatcaaggtggtggttggcaggcactgttttggaacaaccacgatcaaccgcgggccatcaatcgatttggcgatgtcgggcaatatcgggttaaaagcgcagaattgctggcagcagcgattcatttgagccgcggcacaccttatatctatatgggcgaggagattgggatgactgatcctgtttacaccagcatggcagattatgtggatgtggaagctaagaatgcttatgcagcactgctgggaaaaggcatgtctgaaaaagaagcattcggcattattttggcgaaagcccgagataatagccgaacgccaatgcaatgggatgcctcggaccatgcaggctttaccactggcacgccttggttgcgaccaacaaatcaagctgcaattaatgtgcaggctgagcttgcacatggtgaaatttttaaattttatcagcagctgatcgcattgcgtaaacagtatccagtgatcagtgacggtagctacacgccgtttggaactgaaattgatcggttgtatgcctatataagaacatatggcacacaacaattgctggtgctgaataatttcagcgacaagacaatgaccgtaccgctacccgaaaagtttcaaactgcaaaagtattaatcacgaacgaagctacattgacgccaaccgcaaccatgacattgccgccatacgtgacgattgggttattgcagaaagcgtgatttggctggttcgctagaagaaggcacttaagacaaagcgcagctgggttttcgtgccagcaagcgtgttgataaaagggggaacaagaaatggcagatacgaaaaagttgcagctcatggcaccggtctccggcttggccatggcaattaccgatgtttctgatccggttttttcacagaaaatgatgggtgacggttttggcatcgatccgactgatggtcagattgccgcaccagttgacgggcggattatgatgatcgcggacaccaaacatgcgattggcatcaaagccgataacggcgcagaattattggttcatttgggaatcgacacagtcgagctgaaaggcgcaccgttcgaaattgatacggctatggatgcccgtgtcaaagcaggtgatctcatcggatcgatggatttggacgcaattaagaaagctgggaaaaagacaaccgtcattgttgcgattaccaatagcaaagaagtcctcgatcatctcgacgtcaatgctggtgaagtgaaccgcggtgaagaagttgccgtgatgacgccaaagccaatggccgcaacagccgctgctgcgccgaagaacgaaagcaaatatgccgcaaccgctcggcagattattgccgatgttggtggttcgcagaatgtgaatagcctgattcattgcattacgcggttacgtttttatctgaaggatgaacagttaccagatgatgacaccgttagaaatattcctggtgtgattgatgttgcgcatggcaatggtcagtatcaggtcgtcattgggcaagcggtcactgacgtttatgatgaagcaattaaacaattgggtcccagttatgctaacgcggaaggaacggcgcaggcaatccaggagactcagcaagaagctcaagataccagtgcgatgggccgaatcaaacacgggctgcaggcactaattgggacaatcacaggctcgatgattccgattattgggcttttggctgccagcgggatgttaaaagggattttgctcggcttaacaaaatggggcggtttatcaacgactaatccgacctatgaaattattaacgcgatgggcgacgcaaccttctactttctaccgatacttgttggcttcaccgcggcacaaaaacttggctctgatccggtgattgttggtattatcggcgcgttcctgatctatccttctattgcgcaaatcgccacagcaggtaaagtcagcggcacattgctaggcatgagtattaatgccaacttcttcggtttgccagtgcacattgccaattacacgtattctatttttccaatgatctttgcggcgtggatggcggcgaagctcgaaccgtggatcaagagttggatgccattggtgcttagaatgatcttcagtccgttggttgaaatcttcttggttgggatgactgttgttctggttgtcggaccattactcactgtggcatcaggcgctttgacatcagggattcaagcattgctgaatttgaccccaatgatttcaggtgccatcattgccggtctctatcaggtgctggttatcttcgggctgcactgggcggtcattccgattatcgccgcacaattatcatcggcacatcctgaatcaattctgaacgggattgtctcgatctccatgatcgcacaaggtgccggtgcgttggcagtttgggtgaagacaaaacacaatccagccctgaaaggtttgtcgctttcagcctttatcagtgcctgttgcgggattaccgaaccagccatgtacggggttaacctgaagtatggccgggtcttcatctttgcaagtatcggcgctgcaatcggcggtctggtcaatgggctgcttggggttaacatgttcggcttcaccggtagcttcatcgggttcttctcgtttgatgcgccggcttgggcaaacagtcccaataacttaatgaatttctggattgcttccattgtgacgcttgtggctgccttcctactggtttacttctttggttataaagatgctgacgccaatcaagcaaaaacggcgccaaagaaaaagcgtttaggcaaaacagttgaataatggcgtgttcaccaacacgtacggttttcatgtgtgcgtgagcggcaacaattgattaaaaaagcacgatgtcagcggacatcgtgcttttttcgatttcaaggcatgccgaagagcaaggtgctcgtatgacgatacatggtactaacgcttggttaaaaatgagcaaatcatggcaatggtggataagcacttttaattaagcgtgttattcaatttccctgtccttgctttaaaaagtgatcctatttgaattaaattgcttgcagttgttgtaaaaataaggcaaactaagaagtgctctcatggaaagttaattttatatgaaggaggggccaagatgtataaacggtacaaagatgtttcgttgatcttaaaaattgtcattgggatcattgttggggcagtgttaggggtaatggtgccctcctggtcctttattgatgttctcggtaaattattcgttggcgctttaaaagcgattgcgccactactggtctttctattaattatgtcggcgatctctaagtatcgctcaggtgcgaagaaccactttggcaccgtcattgtgctttatctcagtgccacgttgttttcatcaattgctgccgtggcggtctcgtatctttttccgatcaaattggtgttgcccggtgcgatgaagatcgccgaaagtgcaccgaaagatctggggactgttgtgacgagcttactaaccaatgccgttgccaatccaatctctgcattggttgaaggtaattacctagctattcttttctggtccttactgatcggttccggtttacgattgaccagtgctgtgaccaaaaaggtggtcacggaattggccgatactgtcagcgctgtcgctcaaaatgtcattcagttcgcaccgtttgggattgtcgggttgttacacgagtccttgagcaaaactggtgtcaaaggggtcatggcatatggtcagctgctcatgctgctggttgccacgatggtatttgtttacttagtcgtgtacccattcatggtttggttgatgacccggcaaaatccgtatccgttgactttttggacgctgaaagtcagtggtattccggcattctttacaagaagcggcgctgtcaatattcccatcaacttgaaggcatcaaaagatctcggattaaatgaagaaagttatgcgatctcaattccgcttggtggctcggcaaattctggtggcgcagcgattacggtgtcgatcatgacgttggcaaccgccaataccatgggggtacatgtcagcattttcctagccttattgctatgtttcttgtctgccatctcggctaccggggtttccgggatcgcaggtggctcactgttgttaattccaatggcggcttcattgtttggcatttcaaatgatattgccatgcaggttgtcggtatcggttttatcatcggcgtggttcaagattcggttgaaacggctgttaactccgcgtctgacttgctgttcactgcgactgccgagtatgccgacgatcgccgtgaaggacatccggttgatattcgagctaaggtcaaagcggcaggcaagggaacggcagaagttgtcacacctgaaaaggctaatgaagctgaagaaagtgaacaagtttagttcagtcaaaagaatcgcgaattttcgcgattctttttatgtccagctaatttgagacaaaatgataacgagtgtttttgaattcacatcagacaataacgaatgtctttaaactcacaacgctttccagccaagctgaaatgtgctaacctatttctcatacgttttttaaatatgtgagagactgactgcttgatgagcagtgccatggaggttaccgatggggcaagtttggcaacgattgattagaaaagaagatccaagtgtttatgaagataaggattcacatttaccgcgcgttttacgcgtccgcgattttcttgcgttaggggtcgggacgattgtgtcggcttcgatttttacattaccaggggtggtggcggcaaaacatgctggtcccgctgtgtcgatttctttcttagtagccgcgatagtcgcagggctggttgcgtttgcctacgcggaaatgtcagcggcgatgccatttgccggttcggcttattcttggatcaatgttgttttcggcgaattttttggctggattgccggctgggctttattggcggaatattttatcgcagtggcgtttgtggcgtcaggactttcagctaatttccgcgggctgctggcaaccattggcgtgaattttcctaaagccttggcgaatccggttgggaccgatggtggcatggtcgatctcgttgcagtggtcgtcatggtgctggtcggcttgttattgtcgcggggggtatcaagtgctgcgcgcgttgaaaacatcttggttgtcatgaaggtgctggcaatcctgcttttcttggtggtcggcttgactgcgattcaccctgaaaacttccatccattctttcctgcttatcatctcaatgctgacggtacaccatttggtggttggcaggggatctatgccggagtttcaatgattttccttgcttatattggctttgattccatcgctgctaattctgcggaagccattgacccagagaaaacgatgccacgcggtattctgggttcgttactgattgcagtgttcttgttcgtttcggttggtcttgtgttgttaggtatgttcccatatcaggattatgccaataacgcggagcccgttggctgggcattgcgtcattctggccatgcagtcattgccgttgtggttgaaagcattgcggtcttaggaatgttcacggctttgatcgggatgtccatggctgggtcgcgcttgctttacagttttggccgtgatggcatgctgccgaaaaaactgggtaagctgaacagtcgtaagctgcctaatcatgccttggctgttttgattaccatcggcgttttgatcggcgctttcttcccgtttgcctttttggcccaactgatttcggctggcaccttgatagcctttatgttcgtgacactgggaatctatcgattgcgtccgcgtgaaggccaagatatcgccaaaccgcgcttccggatgccactgtatccagttttgccagcagttgccttcctgggatcacttatcgttttccttgggctcgacattcaagccaaactgtattccggtgtctggttcctgatcggctgtgccatttacttcctgtacggcatgcgtcactcggctctgacaaagggatcagcggttgagcaagaaactgctgcgttaggacaagaaaaagattaaaaaagccgctgcctgagattgcccgcgttgtgacgcgcggtctcggacagcggttttttggtacggtggcttagtgatactcgtctggagagacaccgttaagctgagcgcttaacctgacgagcctaagcttcttgagccttcttcagattttctttcaaaatagctgcagaatcggctaaacgcttatgatcttctgggttcaaatccagctcaatgatgcgttccaagccattagcgccgaggattaccggtacaccgatggaaacacctgacaagccgtattcgccttccaaatggacggacattgcgaatgctgcgcgatcatcattcaagaaggcgctggttaaacgggttaatgaggcagcaatgccgtagaaagtggcaccttttttctcaatgatgccataagcagccgttttgacgcgctcgctaatatcaggcagatctttatcctggcgatctttaggaatccaatcaagaatcggtttgccgccaatgttggtgtagtcccaaactggaaattcagaatcgccgtgttcacccatgatgtagccgtgcacaatccgggcgtccacgttataacgcagaccgatctcagaccgtaagcgagctgaatcaagcgccgtccctgatcccagcacctgattacgtggcaagccggattcttgcaagactaattcggcaaggacatcgactggattggatgcgactagaataaacccattgaacccgcttgccataatgttatgtgtgatttctttcatgatctttgcgttgatggccaaaagttgtaggcgtgtctgacctggcttttgggcaattccggctgtgatgacgataatatcggcatatttgcaatcttcatagctggccgcataaatattcttctgtgacgtgtaaggtagggcatcagaaagatcttcgacgtcaccttgcacgcgtttttcgttaacatcaataataccaagactctggccgacgccggtggtgagacagttgaacgcataacttgatccaatcgcgccatcaccaattaaaataatattgccgttgttccgcatctcaaattcctcctcatgaagatcttgacgacaggtacccaaaactgcgacaaacgactaagagtgagcagtcatgaagccgattacgacgcgccataaaatcgattgccgccaaagctgttgcatgtatccgatttcattgtaacagaggtctgcatgcagggcttgataaacgactgggaatatttttaatatcaagataactttcttatcaaactgccatctttctgttagtcttgaaacaacgcttgtcacattttcttccagaaaggtggttcctcatgtcagcagcatcttacgtacagtccattctcacaaccctcaaacaacgcgatccgaaccaaccagaattttttgaagccgcatcaacttttttaaaaaccatcacaccggttctcgaaaaacatcctgaatatatgaaagctaatattctcggacgcatcgttgaaccagaacgagcgattcaatttgccataccgtggcaggacgataaaggccaaatccagatcaatcgcggcttccgcgtccaatttaattcggcaatcggaccatacaaaggcggtttgcgcctgcatccttccgtgaatttgagcatcgtcaagttcttgggctttgaacaaatctttaaaaacagtctgacgacattgccgatcggtggggcgaaaggcggcgccgattttgatccgaaaggtaagtcagatgctgaagtgatgcgtttttgccaaagctttatgacggaactcagtaagtatatcggaccggatttagatgtgccggcgggcgatattggcgtgggtgcgcgcgagatcggttatctttatggtcagtacaagcggcttaaaggcgcacaacgcggcgttctgactggcaaggggttgagttatggcggatcgctggcgcggacagaggcgaccggttatggcttgatttactatacagacgagttattgaaggccaacggtgaatctttggctggcaagcgggcggtgatttcaggcgccgggaatgtcgccatttacgccacgcagaaagctgaggagcttggggtcaaggtgatcacggtttctgattcaaacggctatatcgtagacgaaaatggtattgatgtcgcggtcgttaagcagattaaggaagtggaacgtgggcgcataaaagcttacgcagatcgggttgctgactcccattattatgaaggctcggtttgggacgcggatcttcagtatgatttagctctgccttgcgctacccaaaatgagattgacggcactcaggctgcgcgttttaaggctgctggcgtcatcgcggtggcagaaggtgcaaatatgccgagtgacccagaggccatcactgcctacactgatgctggtattttgtacggcccggcaaaagcggccaatgctggcggggtagccgtttccgcactcgagatgagtcaaaattcgcggcgcctcagtgacagttttgaaaaagtcgatggccaactgcatgacatcatgcagcatatttttaaagctagcgcggatgctgccgctgaatatggtatggccggtgattatgaggccggcgccaatattgccggctttctgaaagtggctgacgcgatgtattatcaaggcatgtaggtatatttagacattaattagaaaaaaacacgaaataattaggtgtttttttccgaacgtgttatactctgtacatggtaatacttgaacgggaaacatcatgttacgtgaatttcctttttaggattacggttgtctgttgttgttagttttgaaaaggagattcattttcatgcaaaaaggtacagttaaatggttcaatgctgataagggttacggcttcatcactggtgaagacggccaagacgtctttgtacatttcagcgccatcaatggcgaaggctacaagagtcttgacgaaggtcaggctgtttcctacgatgtagaacaatctgatcgtggtcctcaggctgctaacgttaccaagctttaattcttggttcgttaaaggagatccaatcgggaaaccgattgggtctttttttatgagcgcaaacaggagcacctatattcaggcttttgcgactgcgacagcattattgcggcgctggtccttgtagtagtccaagccacctgatttcattctaggcaggctctcacgcttgctgcttcaaggttaattgccacacactaacaagcacccaacaagcaaatggcatcgcagcgacaaacaagcctatgaagattaatcctggtgcatcgccactttcggcccatagatagctgaaggttaagctgatggcagcaatgatgatggttatgccgcctaggagccattgcaagcgacgaacgccgcgggtgacctgctgcgatgaacagatgatttgccacaaggtgatggcgctggcggcgatcccgccaagtacaagccagccgccaagcaggacgagaattaatgaaacagttggttggacagttaacaacagtaaaatcgttgcccataaaccgatagcaaggaaaactacactgcccagtagcaggctaagtgccaaaacaagatgatgttggcggacccacaaagatgattttgacattttaacaacctccaattagtccatacgctagcgcattgttgcgttcaatagtcgagtgaccgcgtttcttgacgaaaaaacaaagaaggtatcagcctaaacgccggtaccttctttattatctttgagaaaaagtcgtggcgctgatgacttactcgcctagcgttggctcgtctgtgaaatcatcaacgatgcggaagctgacattttcattttctttcaaaagtttggcaactgggcattcgtccagtgcctgagtgacaatcttttgtgcttcttcgcgggtgtggctcggcatcaagatttgtgcgtctacgatgaatttgtagccaatcttgtcacgggtgatgtctacacgagtacggagctgggaatcttcagcagtgccttcgcgatgctgcacgatgcggatggtcgcattaaaacaggtagacaaggcaaaagcaatgaactgctccgggttggtcccaggggcgtcaatcaaggagctagaaacacccaacgctaagccttgattaccttcgacataactttcaccgactaaaccattttcgttgcggacataggtatgatacaaagaacgttctgccatgctattcatcctttcttatagctatcaccgtgagtataacatggaaccgctttacatgggggcattgtgtctcggttgcaacgcctgaatcgctacgtaccaaggcgttttggaatggataacaaacattttcaatgggttttgttttgccacaaaaactaagcagttattgctagtgtcgccataaaagctcagtcagtcatggttgcaggcgaatgatttttgtcgcaacctgctcgataaaatgctcatcgtgttcgacaaaaagcatcgttggttgataatgtttgatggcggcaaccagttggtcttggttgtaagtgtccaaataattgagcggttcgtcccaaatgtacaaagcggccggggtggctagcgatcgcgctagttcgacttttttctgttggcccatgctcagatgctcaatcggcgtgttaaagtcggctcgcggcatgccaagtttgcgcaagttgttaagcaaggtttcacggctaagctgatgctgtttggcaaagtcgactaatgtaccgcggttatcggtgtattgttggcgaacaaggctaagactgacgggtgccaaggtgagatgccctgactgcatgccggtgaactgcttcagcaaggcgcgaatcaaggtcgacttgccgctgccattgtcaccaacaatggcaatccgatcgccgcgggtcaaagtaaaagagatcggctggaaaagcggtagatcgaacccgacttggaccttttcagcgaccacaagttgatggtgatgggttgacaccggcagcatggtgagtggatcaaccttttctaggttcttcagaagactttccttctcatcgatttctttagtcatccggtgttcgagatttttactttttttcatcgtccgtgcagctcgagcgctaataaacccgcgaccagcattatgaccgctgtccttgatgtgcggattaccatagatactcttttctttattttccgcccaaactgttttatcatgggccgttcgtttaagtcgggtaatttcagttttaagttgaccatttttggccagttcagtttgatcttgccgttctttttcggtcatgaaggtggagaaattgccttgataaagggtgatttgctgccgctggattgctagcgtatggtcggtgatgctgtccaaaaaatcacgatcatggctgacgacaataaagccgggtttttgttggagataggcggcgacttgtcggcggctgcgcaggtcgaggtgattggttggctcgtcaatgagtgcgaaaccattgtcttgaatgaacagtaaggcgagacgcacttttgtttgctcaccaccagataaatcgacaaatgggcgccagagaatgttaggatcagcgtggagcagatttagttcacgttcgagttgccattgcgcaacatcggtgatggcttgtgcggcagtcagcgtcagttgggtttcatccagcgtttgaggaaaatattgcaactgcaagggaacagtcaccgtgccactgtagggtagtgcttgttgtaaaattcgcaacaaagtggttttgcctcggccgttgcgaccgaccaatccgagatgccagttggtatcaaggtcaaaggttgtgttcgtaaaaagcggtgcttgaccgtcataagcaaaattgagctgtttaatttgaatcgtagacatacagccacgtcctttcggggatgtgcctgcgtgatcagaacgtgaatcggtatgactttttatggctgaaaagtgttgaaagttagcggcatcagccttgctattgggttatttggcagcataactgcgctggcttgtatgcaacaaaaaagccagcccaataacactttgggactgaccaaaataaacgggggtgccgtccttgatcaagcccaattgtcaaaaagtccgtactaatcccgttgatgatgacaggacttggacattttcaacaattggcttacttcaatggacgaaacctcactttcgaatttaacttagccttaaattaccacgtgaagctactggcgtcaaacatgtaatgctttcacaatcgcttcattaccacttgcaatcttcactgtgtctcgatggcgattgctgtctaaggctgctactaggacgtcagcaacatctgcgcgtggaatggttgatggtcgttgcggttgcaaggtgatactgccttgtgcaggatcgttggtgagcgcggttggctggacgatgacgtaatccagatccgtgttgtgaatgagccattcgtcagcgtagtacttggcgatgtaataatcgtgcaactggtctggccacttgtccggatcttcagcatcaagggcgctgagcatgatgaatcgactaatatcagcgcgttcagcagctttcatcgttttgacagcaccatctagatcaacgccaagaagatcttgaccgcgtgaccctgctgcgaagacaattgcgtcatgaccagcataaaggtcagctaagcgatcaaccggccatgaaagatcaagttcgacagcgcgaaagtttttctcgggatcaggtgtctgcgcgattggatcacgataaccgcctgtaactgtatcaccacgatcaagcagtttgtggaccagcaactggccgatttggccgtgggcaccgacaacaaagattttcaaaacaaatatcctttcatggaaaatgattgctattagtataacgttttttatgacagcaagaaagcaattgcaggcaggaatgctaaaaagtttagtgcggtgagtttttcagataatctgtttgtggtcacagaacgccttccgtcagggccttgaagtagttcggtctgcggccataaaaaaggaacggggtgaaacgtaattatcagccagttaaaaaagaacagtttttttgcattttgcaggagaattggtctttttgcctgctcatggattgttgattgcgatttttaagaccgtagtgccaaggcgaagcaatcgtaggccagatggggctcagccgtgcaaacaacacagcgaccgggctttggagctgatgttgttaggcgacttcgagaccgcgggctttgcgggctcgaagcgccgtcacagcgttccagccccagctggccggagattgcggagtttggcacggcaagaagattttagcccagcacctcctacgattattcggaatctaatcaattacaagtcgtacgaagaaattacgactaaccttcttcatgctgttatcgttaaatcatttcaagtgggatatgatgccgcggggctgggaaggcttgttcgaacaatgtcaattcatctggtgaaaaagtaacgtcggcagcagcaatattttccgccatgtggcttgcttcacctgaacgagggatcgtgagcacgtcgccatgacgcagcacccatgcgagcatcagttgatgggttgaaatgtttttctctttggccaaagttcttagttccggtggcagtttaattgacttgccactgcctgacccaaatggcgagtaaccaattgtggtaatgttggcctgcttttgctgtggcagcagatcatattcaataccgcgcgattgtaagttataaagcacttcattagccgcaatttggtcgccgcccggttcgagcgttaattgatccatgtcatcaacgtcaaagttcgacacaccatattgcttaattaaaccttctttttgcaaatcctgcaggccttcgagagtttctgctaacggggttgacccgcgccagtgaagcagatataggtcgagataatcagttcgcaatcgtttaagactattttttagggctgttcgcatctgtcgcttgtctgcgtgtgacggatagaactttgagatcagatagatgttggcgcgatcataatcaccaagaaaactgccaatcagtgactcagccgccccgttgccatacatctccgcggtatcaatcacggtcaaaccatgattcagtccatactttaaggcagcagcttcctgttcactttgtgccgcattgccttcgcctaagtaccaagtgcccatacccatgatcggaacattgacgccaccaatcttgattgttttcatgatccgactcctttctttcaacacatctattatacaagttgtgaaaaaaatgaccgctttaaatagcgcttgtgaaagaagataaaaaaagcgtgttacctacgcatgaacgtgcatttttttgcaggtcacgagacagttttcacacttctccatatcaattagttgctgaaatttgctattgccgattagctttaacaggttgcgtcgcaggctttcgacgttgatacaacaagtaatgcagcacgaccaaaccaagaaagacgacacctactaataatgaaacacttgtttctgggtttagtagcatgaaaaataaagtgaacgcgaggaaaataagtgtgagataattgctgtaaggcgcgaatggcattttgaaaggatggttggccatctgatcagcgtggactttgcgaaagcgaatttcgctgactaagatgacgatccacggcaccataccaggcaagacgctggaactgtaaactagcacgaaaacatttttcgcggctggtgcaatgtgaggcagtaaagcattcaaaatgacgcccagtaaaatcccgccgcccacggcgatgaccggataaaaaggtaccccatgacgatttagtttggtgaaaattcgtggcagttgtttggcatcagctaaggtgtataacattcggctggctgagtaaatgccagaattggagccagataaggcagcggtaatcactacaaaattaatgagtgaagcggcaaatgtgatgccgattttggcaaatgtctgaacaaacggcgaccctaacgtgctgagctgattccaagggtaaatggcgacgatcacgaaaatcgcaccaacatagaaaatcagaattcgaccaatcgtgtctttcactgctttaacgatggtcggtcgcggattctcagcttcacctgctgtgataccaagcagctcaacgccttggtaggagccgaggacgattgacaaggcaaaacagaagcctttaaacccgccggtgaaaaacccaccgtgggtccagagattgctgataccaaccggatggccgccattaccaatcccaaataaaatgacgccaaggccagcaatgatcatcaaaacgatcgtcacgactttaatcaaggcaaaccagaattccaattcgccaaacattcgcaccgaaattagatttgctagtacaaggaaggtgatggccactaaccccggcagccaacccggcaacccgggccaccagaatttgaaatattcgccaattgcgatcatttcggacataccaacaacaacaaattggaaaatgttgctccaagcagtgagatagccaaaaatcggatgcatgtattcactggcaaacttggcaaatgaaccagttgccggatcaatataaagcatctcgcccaatgcacgcatgatcatgtaaaggaataggccggcaatgatgtaggcgatcagaacagatggccctgtccatttaatcgtggcgcctgctcccatgaaaaggccaacgccgatggtaccgccaagcgcaatcatttgcatgtgacggctgctgagttttcgttgcatggttattttcgcttctttcgtcttgagaaatacaagtaatgactatacaagaaaagtctaaccggcgcaaacaggtggctatgaaacgtagacatgaaataggcatcaccgttaacacgcttcttgacattcaagtcactatgtccgttatcggcttttgcggtaaactagtgacggatcattcaataaagtaggatatgaggaaatattttggataacaaaaacaaattcacggcatcattaaatgcctatatggcaaaacacaagttgaacaccaatgcgacatccgcagcgatgggtgtttccgtgccgactttgcgtaaagcactgcgcggccaaagcgtgagccgcaagaccgcggctaagattgaaagcatcattaagtctggcaaggtgccagcagaagctcacaaaaccgctacgaaggcgccagctaagaagacggcgcctaagaaaccagctgcaagtaaacaggttaaaccagccgcgacagcgaagcagccagctgcaaaagccaaacaaactaaatcggctgaacaagtgtcagcaagtaaatcagcgacaacaccaaaagcctcgcgtgttcaaactaagcgggcagccaatcagcagtcgcaagcaactagccaaacgccgactgcaccacaaactgaagcagcagcaagttcaaaaccggcacggcgcactgctaaacgggtgacgcgttcaactgtcacgtcacggcaaaaccagcgccccaacaatcagcaagagcacaacaacaacgagcaaacaccgaaacagacgcctgttcagaaaaaaattccgacgcggcagcatcgcttcacgattcgccagcagccggatgttgcgacacaggaagcagaagctgaggctaagaaacgtcagactgaagctaatcggtcatctgtatcggctagctcatcttcaagtcagcaatcgactgagcagcgtcacgacaatcagacagagcgtcacatcaagaagcggacagtaacggccccacggcgcaatgtgaataaaaccgatcacgaacctgcccggcgtgataatggctatacgcgcaataatcgcaataagccaaatggtaatcgccagcctaaccgcacgcgccaaaatcgattcgcagccaacgctgatcctcaaaactggcagccaatgactcagccggcggcatcaagtgcctcacagtcaatgacagccaaagcgtcgaccgacaatcgccatgtgccagcagtggttaatcacgttgaaacgcatacaccaagtgtgattcggtcaactttaaatgaccgtaacggcaaatacaattcagctaatactgcaagcagcagtaccagcgatacgaccagtcaacaggcaacgaccggtaccaacatgcatactaattatggtactcatgatgaagcaccgttggtagctggcaaacagttgcaactctttattgatgaaagttttgaagagcaccgtccagatccgcgtaccatgcacatggggatcgcggctattttcccagaaggcgacgacgacagtctcattggcttccgtaatgcgctctatccctatggctgggaaccaggggatgaagttaaagcccgcggtaaacaggttgatgccttaacacagctgatcaaagcagctgaccatgaaaacatggggatgtataccgtcttttcacagaaaacgacgtatcctgatttcgccccgtcaatggaatatctgtatccatacatcggcgccacgattcacgtgttgcgtgatgttgacactacttttgacagtattgtgatcatgatcgatcatcggaatgaattggaaggtaatcagctggtgatgggcgctgatattgtgagtcgctacttgacgctttccttggaacgaccaatcaaggttcggtttgagtttgcagattctcgcgagcatctcggcttgcaactgtcagactttgttgccaatgctgctctgcggcttagtaatgacgaactgagcctcattgggatcacgccaatgcctgagttgggcgtttcgcaacacgatcaattagtccgattgacgttacttggcttgcagcaggttgtgatgggtgtgcgcgccgaacgagctgcaacaccatcaaaacattcacaacctgatcgcttcatgcagctgatctttgatgccacttacgccgattccgatcaggtacgcggtgcgctgccggttgtcaaaaatgcggtcgagcaactcatcgatgttttgccaaatgcccgggtcggtcaaatctccggtatgccaaaccaaagctggtatgacatgacagcgcggatggcaggactattacggtatatcaacaaggatccaaaaccatatggccgggtgcttgcaaagatcgaaagcgtgacgaagactgccgctgacgaactggaaatggcacttgattctgacgataaagccaagcattaattgggttttaaatgacaaaaagggtactgcaatttaaccattgcagtaccctttttttagataatcaagcgttgttacttagtgtgttctttttaagcaatgaaactattctgattttgtaggtacgtaatttcgtcaaaagtaatgcgtgtctgcaaccgttgcatgatctcccggttgagtttgccttcagcaaaagcaccttgaatgaactcaaattcagcatggaatgcctttaggaacatggcatatagcacatcaccatcgaaagaatccgtatgaacccggcgatgccgatcacgatagaagcggcgaacgatgttgatggcactacgattttgactattttcggcacttgccaagtacttcatcaccgcatcatagccggcctgctcgataggtaatagatcttcaccgtgctcagtaaattgccgtttccaaaaaatcggctcaaggttaagcggtgtggttaaaaaagcattttgcgcttcgtctagacctttatacatacgtcccatattaaaggtgaaccgtaagcggagaaaaagatttttccacgttcgctgatctgctgtgaaatcatttaaatcaataaagcgattgtaatagtgcgcttcgtcatgcgtgatggtcccattgacccgtaaagcttcaatggttcttttctcaacttttatggtggcatcaaagatatcccgttgcattcttcgcgaaggtttatcgttcagaatcatttcctgagacaacgcgtctgcaacgatttgggcttcgctatgatgaacggattcatcccgcatggcatcaatgccagctgataacattcggcgcaaccaaacatattggcgattgcgttttggctgcttaggcacgcagaatggtagaaccagtaccggcacaatcagactgagtaaaatgacagttgccgcgattagaatcaagccttgccggagcggaaaactgtggccattaacaatttgtggcattgaaaacgccaaagataaggtgatggtcccattcgcaccacccagcatcataatgacggcgttgcgccagcggtgttttttaccagttcgcagcaaggttcgactccatagtaggcgaaccagtgacttggctgcgtaaatgaaaatgccaatacccacaagcaaactgaacaagccagcttgtccgcgcaaggcgctaacgatgacattgggcagcgagaggccgagcaaaacgaagacgagtccggaaagaatggccgctaccatttcccagacattggcgctgacgatttgcatgcgggcactggtcagtcgcaaacgatcgcgctctacaccttgcgcaatcccagaagcaacaaccgccagaatcccagacaggccaagttcttcggctagaaaataaaccaacaatggcgtcagtaactgaataccgaccatgatcaacggctcatcgtcgccgatatgaatcagccaggcccgcaaattcacgatcagcatacctaagactgccccgaccaggataccgccgaagaagacgaagagaaaatcgagcaaggcgtctgttggtgaaaattgtccggaaacataggcagtcagtgccagatcgaatgcgacaatgccggctgcatcgttgaacagactttcattggacaatagttgcatttggctgtcgctcaaaggattggtttgggcaacggcgctgaccgctgatgcatctgttggcgtgacgatagcaatgagtgcgaaggcaagacttagtggaatgattggaaacagcgcatgaacgccaaagcctaaaataatgactgaaaccagcacgaggccgactgccaacgacacgatattggttaaagagcggccaatttgaatacgtgaagcattttgaccttcgttaaacaacagtggggcaatgatcgcaaaggagaagaccgatggatcaagtgtgaaattacgaagagaaggcataacggctaatgccgccccaaggccgatcaagaagaatggcaacggaatcttaggaacgtgccgtgccaagatgttgcctaaaatgacgattgccaacatgatgccaaagataacaacctggttcaaaaatgatcacttccttgattgaccttatttgacctttctattttagcaccaatgcaaaaaaataaccgctcattggtctgcgactgtgagcgcgttttctacaacggcgggtatgctgacaataaggatggcttgtaagtattctttttcattgggttgagcatctttattgctatgctaatgatgttggttccgatagcctgagctggctacgcggtgattcgggggtggcgaccgcggaactaccgggaacaacctaaccagaatagaataaccgacactttaaacagattatgcgttagtgacacaacgacaactcacttcttcaaccgcttttttaaaatgcgcgtcatttttctagccgtcacgcgccaagagaggtatagggcgatccaaatgaaggcgtagatgacgatgaacgaaatgatgaagctggttaaggcggagccaatcaagaattgccagcccatcaggtagttcgttgcaaggacgaccagaaaggtgctgatgaaatgggtgccatatgcaactggtaaactgagccagtcaagatcgaaaatcgacgataggatgccaatgacggcactcatgatgaacagtcccgcgatagaacgcggtgttggattaatcgtgtctaaatgcaacatcaaagtggtcagataaacggttgcgccgatcatgatgccaatgacggcctcggtcaataactgctttgcgattctcataagggccacctcacaatcctaataaacgtttcaagtcaggaagaaatttacgactgaccgtcaatttttgctgattactcatgaaggcggtcatattaccggaaaaagaagcttccagtgatgtcaaataattgatgttcagaatggtacttttggctacctgaataaaaagctgaggatcaagcttagcgcgaatggcttttagctggccacgcgaagtatagaccttggtcatcgtgtggaccgtgagctcgtcaccgtagacttcgattgccacgatgtcattaacggccagtaccacgacgcggtcaccaacagttagcggaagggttggtcgattgtcggataattgttgaatttgttgcaagagctgcaacacagccggtgaaagccgcgcagccttgatgagcacctcaatatcatccggattcaagtcaggatcttgatcaaatgaaactttcataggctcagtctccttccgcatgacgccagcgtatcgcacgattacgtttcattatacgcgggcgagggcggcctttcgactgaatctggcaagaaggaaaataaggatgctcacaccaagcgtaaaaccaatcagaatcatgtaagtgtggctgctagaaagcaagccgttgacgtcaatgcgaacacccaacattttttcaaaactcgcccttgcagcctcttgcttgccagtgaaggtcgtggctaacggcttttgcaacagaatctggcgataaatatgggaagggggtcattttcatcaaggcttgtgcgccgctgggaactgccccgattggcatgtaaaccccagcgaagaagcctgctgcagtaccgacaatggttgcaatgccgctcatggtggtcacgcgggaaacaaagctcaaaataagtaaattaaaacttgtccaaaccacactgctgaacaatgcgagagcaatgattttgccagttagttgccatggaataacgacatgatcaagcagggcgaaggcgcctgacatggcaccgaacatgagcagctgcatgatggtgccgatgatgacggcactggccagatagccaaattgaatgcgcagataagaagcttcggtcaacaggtagtcgcttaaattaccattctcacgatcaacaatcattcttgctaagccatcttgcgtggtcgtaactgccgtgatggtaagcgtgccgccgattagccagggatcaagcagcttttcaggatgactgatgggccacagtccggtcatattctttttgagaaaaaccaaatagagaacgaaggcaatcagtgcgcccaaaactgaaaagaaaacgccggcgcgattgcgaaaaaacaacaatagattacgtttaataaaagctagcattagcgaatctcctttccggttaacgtgacgaagatcgtattcatatcagctggatggaactcaaagtcggtgatggcatcggtgagttccgtcagcaaagcaatagcctgttgcggatgatggatattgacgtgcacctcgttggcaacgatattggcccgcaatccggcttgattggcgactgttttgacgcgatcggcagctgttgtttgaattgtcagttgatgagcagcatagcgatttttcaggtcaacaacggtatctgctgcaatgatttcgccacgatcaatgacgtaaacgaagtcagcattttccgtttcctccaaataatgggttgttaaaatgacggtcaattgcgtttggacgcgtaaagcagccagcgctgaccaaatcgtttggcgcgtctgaatatctaatccggttgacggttcgtctaaaaataaaatttggggatgattcaaaagggcgcgggcaatatcggttcggcgtcgctgaccacctgacaatgtcccatatgtctgattcaaaataggtgccaggtcaaattgcttaatcagttgatcgaaccaagcagtatctgggtgttgatacatgcgcgcccgcaatcgtagattttcattaactgttagttggcgatcaaggacactatcctgaaagacaaccccaatctgttgacgataggccacttgctcaggtgtgtgatcggcgacggtaatggtgccactggtcggttgaatcaagcctgtcagcatgccgattgtcgtcgatttacctgcgccgttaggacctaagaaggccacgaattgcccacggtcaaccgtcaaattaatgccgttcactgctactttcggaccaaatgttttggtcagaccctttgcttcaagaatggccattgatgtcacctgctttcgatttgttggccttagcataacgacgattgcgccaagtgtctcgagaaaggcggtaagtggtgcaaaatgcttggcaagtggttgaaaatagcaaatgaaaaatagaattttttcttggcaatttacaaatgagttgggaatgcgattttatcgaggcaacaaaaaacagcttgtgagaatcaagccacaagctgcagatagtttttagctactcaggtaaataaaaagtgcaagatttcagcatccacataaggattttggtgcagcgtcgagtgataagcgccaactggtgtgccagtataaacaaagagggtggtggataagccagccgccttaaatttggcggctaaacgtttgacaccagcaaggctgacggcccagtcaccttttgccccgaagacctgtccgccaatcactaagatatgcaatgttttcggtaacgcccgaatctgggtcgttggatcacgatagaactcgctcgcaaacgagacataattgatcacttgcggctgaagattggcatgcggtgtcgtcatgtaattaaagctcagattgctgcccattgaatgacctaccagattcacacgagtcacatgacgctggacgcgaagccagtgcagcaagtcggtgagttgccggacttccttttgtggtgacttagcatcggcaaaaacaacgttgatgagcggatttttgccattgtagcggtcggctccagtgatcgtgcgtttgccgtcagcactgacatgaatcgtagtgacttgatcggatgccttatcctgcttgaagcgttgaaccattggcccgaaggtgaggctgttactgccataaccagggacaaaaactgtgacgatacccgtatgacgatagatttgctggtgaattgcgcggctgcccagttgccaccaaagccaatagccgccgctagcgagaagcaaaattaccagtaccgatatgcttactcgccgccagcgttttgctgatttagccatgaagagggtcatctcctgctgaacgcttcagttgcttgaaaacgcctcggaaaattggtcgccgattgatcgcttgcacatggcgattattcggttcaaaaaactgctgatagcgggcgagctgattcgaactcattgtgatctcggtttgctcaatgacataccaagtcacgccttcggttaacggcggggtggtgagcgagccgaggtactgataaaccgtaccttgttttggcagtaggcgagtcaggtcaaagttgattggctgcgtgacatgtggttgaaaatgatcgagcacatcggccatgatcgggttagcttgaccaactggcactaaaaccgccacgacacaaagcgcaccaatggccgattgatggacaaaatggagctccgccaccgttttctcagcaacgatatgctccgctggcacgtgaaaatgggcctgcacaaaagtccaagtggtttcattaatccgagtcgttccttggccagcgagccgaatggtgacctggtcatcaatttcttgatcggtcatccatggtgtgagaatcgtcatgtcagtgtcgacagtggttgtcgcttgacgaagatcaatcggtgattgctggaagccgaaaccatttggccaggaagactgcttggcataattcaaaattgacatcgtgacaatcctttcaaaaaatgaattggcagtgggcagtcgaaacttctgctgttaaaaacgaaatgcaccagaagtcatttagcagacagagactaagaaaatcaaaactagagatgaacttttctctagagccaattttgctcagcaaatcctactgacttctggcgcacatgatgggcagttattcggctgaagaagggatgctttttagttgagaaatttcacagccgtgccatatgcaacaacactttgcatgtcaccgccaattgatccggagtcaaaccgcatcattacaactgcatcgccaccagctttttgggcttcgtcgcgtaaccgctcgatcgccttttcccgtgattcatgcagcatatcactgtaggctttgatttcaccgccgacaatgttcttcaagcctgcaccaatgttgctgataacattttttgactgtgttgttaagccgaaaacttcgccgatcacttcatattttttgccgggaatgttttcggtggttgtgattaagatttcttgtgccatgagagaatctccttcataaaagttgacgaaacaaatcagtggcgagctatcttgctgcttatcagactaccaccggcttatggtgacaacaagctaaaacgcttagcgtgacaaaaccgttagctagtgtcatcaggtccacatttttggaaaaaaccggagcactagtttgcctcttaaagaagtttttcgccgttagcttctcgtgctaaaaaacagacgcgatcagggcgttacttgaatcacaattcggccttcatgcggctcatccagcaattggtggcctttcacaaagccttcgcgggtaaaaggcaatacatagccgactttgacggttaatttgccttgagacataagattaatcaagactttaagtgcttggccgacttcggagccgccaagcggtcgggtatgaatgaaacggatgccgcggttgaggagcggttcgtgatgactgacagatacgatcagcccattgtccttggccatggcgacatcatcatcaccaccgatcccgtccatggcggcattaatcacgacgtcggcggttttggcaagctccttgacaggattcccgcggtcataagcgacaaaatgttcaacccctagttgattcacatcaacttcatggcggctggcggcgataccaatcaccgaagcaccgcgggcaacggctaattggatggctgcggaaccgacaccgccagaggcgcctttcacgatgacggtttcgccatcgtgaatatgcccaagttcgaccattcgataaccggtcacgccgggggtgatcagagccacaccgttttcaggcgggatggactcaggcagtaacacactcatgtcagctgcggccgtcacaatttctgcgtaagcactggtggtgcgcgcaacgacgcgatcaccaagtgcaaattgcgttacctgatcgccgacagcactgacaatgccagcaacatcataacccggcaccgttaagccactgccacccatttgacgagcaatgcgatcacgattattcagaccgatcgcttgggacttgatttgaatttcctgtggtcctggcgctggtgtggccaagtcgatcgcatcaatcacttctggcccgccagcatgactaaacccatatccaagcatcttgttccctcctcattaacgtgctcaccagcgcagttgcctgcacctgaggcagcttacacgccggtttcttctgcgttggttcacgttaagcctctatatgtcggcattttacccatggtaagaaagaaaaaacaattaaaacgacctagccgcttaggggtggaaacctcttacgcagctaggtcgctatgaaggtgatacatggtggaaatgaacgaaccggccatcagtagattaccgattttctcttcgcggctggggatcaaaaccatgtaactggcctttaaattcatcaggattttgactgacataagtaccgcgggcccaactggcagcgacagtttcatcaactggttcatcgtgttcgctgtaatccagccccattttttcagcagcaggggagacccgaatgctgacgaattgtttgagaactacagtgattagactgaccatagcaccaactaagacgatcacgatggcggtgccgacaaactggattaggagcagctgccatccaccgccataagccaagccagcgtgcgcaatgtcgggggcgacctgtttgctggcgaacacaccagtcaaaatactgccgacaatcccagcgaccccatggcagccaaaggcgtctaaagtatcatcaatgcctagccgtggcttgattttgctgataaaccagtagcttgtcaacgttgccgcaacgccaatgcatgctgccccaaaactcgtgacatagccagtggccggggtgatcccgacaagcccacacaaggcaccggtacaagttccgatcagcgttggatggccggtttgccagatgtccagacacatccatgtgaccaacgccgcggcggcgccaaccgaagtcgttaatgctgccgtcatcgccgcttgattaacaccgagtgcagagccggcgttgaatccataccagccgatccataaaatggccgtgcctagaagcacccaaggccgattatacggtgtgatatgttcatccgtgcggcgacctagaaaggcggatagcgtcaaggcggtaatgccagcattgatgtggatcaccgtgccgcctgcaaaatcaagcacacccagaccggccaataaaccgtgcggactccagatcaagtggacaagcgggtaataaactagcaatgaccacaagacgataaaacaagtcagaaacttaaaatgcatccgaccaacgacagcgccgacaaacaaggccggcgtgatgatggcaaacatcatttggaacagcacatacacgccggttggaattttcgccgtggtcaccgcgccaagcgaaagatcactcaaaaagaaatgatgaacctgaccgatgacaccgaaaagatcgccattaaaactgagctcatagccgacagcgacccaaagtaggatcgcaatcccggtgatgtagaaaaccgacagcatcgtattaatcacgttgcgtttggaaaccagtccaccgtagaaaaaagccagtcccggcgtcataaaccagactaatgtactcgcaataattacaaacccagtatcagctaaattcatctctgccacctcattaccattgatggcggtattgtagcatggcattttcaatggaatagcgattcggtcgatctattggcctagagcaaatctggtgctgaaaggagaaagactgctatcaaaggattttcgaagcggtaaaaaaactgaagccgcgttagcttatgtgacatgaaaacttgacgattttatggcaagcagaaaaattgaccattggtctatgtacgaaaattggtttttaaatgaatataagtgaacgcaaggtttggaaactggcgcaggcgccatgcaaaaacacagggaaaagcggctactaattgcgaccatgccaaacccaagatggtggtgtttggtagccctcagtgtagctgttttccctgtgttcctaaacaaacacgttcattaaagttcgccgtctgcgatttgaccgagcacagatttggacggaatgaagaacaattcgccagtttctggcgtcgaaaaatcaagcaaccgatcagaattgtcaaacatgccttgcaacatacgcttggtgaccgtccaatgacgggcatagccgatgaagtaggttccgttttcgtttttggccggattactgaacgggacattcatgcgcacaattttatgttcaacgccgccgtcattatcctgagaaaccacattgtgggcatttggcagcttcttttcgtcagctaactcaatatcgttgaacttctttcgaccgatggctttttcctggtcctccgtcgtcaaatcgttccatgctttcatattgtgttggtatttttgcgcaaaagcataggagccgttttcaaatgtgggatcttcatcgccgatcaccgcatactctggcgtgtcgagtgcgcttggattttccgtgccgtcgacaaagccaatgatcgctcggccttcgaaatagcggaagccatgggtttcatcgagtgtcacagtctgatcgtcaatgatggtcatgatctctgacatgagttcgaacggaacggctgaattctgcgagcgaatgtggaagaacagatcagctggggttgccactgcggtatattttggcccgacaactggttggaattcctccaactctttaggcaccggtgcagctgggaaaagataatcccacgcttttcgcgacaagccaaatgcaaccgccaactttgcatctgggtagcgaatgttcatgctattgatgaatgctggtaagtgctctgctaagtcggcaatcatggctttgtcggctgcggcatcttcgcgcttaaggtcaagcgtagcaaaaataatgtcagacccggcatccttatagacatcctgtacatcacgtaaatttatggtcatcgttacgcctccaaattagaatcattctaacctactatagtctaccatagcggtggctgattgcaacgatttcgcgatgtttttaacctaggcattcggtggtaaagtaagaacaaaggttgtgattgtttgatgatttcagtagcagatcaagccgaacttgtcattcgactggtggtggctgcactttgcggctttgccattggttatgaacgcaagaatcgcttcaaaaatgccggtatccgcacacatatgattgtggcgttgggtgcggccttgattatgattgtttcaaaatacggtttttttgatattttagatttgaaaaatatggcattggatccttcacgtgtcgcggctcagattgtcagtggcgtcagctttttaggcgctggcgccattttggttcgccacaataacgtgaatggtttaacgacagctgccggggtttggacgacagcggctgtggggatggcaattggggcgaagctgtacctcatcggcttggccgcaactgtcctagtgctctgcattcaagtcctgctccaccatcattatcgttggctgcccagcggggataacggcattttgacaattcgggtccgcagcgaaggctttgacatggtacatttacgcgaaacattaggcaagtaccatatcaaggtcctgaatgtgtccattaaacatgaaggcgacgaagttaaaatgaacctgcatgtggagagtaaagccaatgaagacatgcggcgcctgctgacgttttatgccgacaatccgaatattatttcgattgaattctaggcaatcgctaattaagttggctagtaccgtctgcatagttgagggtcacaccaggctgaacgttgaagatgtagacattaaaatgaatcgtgttgtcgccgatactttgcgcacgcatcgccacaccgcgtggtaacagttcatcaccgcgaaagatcggggtgacttcataacgaataaaatgttggcgtgactgtttcaaataatgtgccatatcatcttcatgggcctgcatcaaaggcgaatttaactgccgcgtcccagtcatcaaatttttcggattattattttcaccggaaagctgaaaaccaattaaatggctgcggttgtacagccattcgccatgcactttcttgttgtgccacccagttggattccaagtcagcggctcgcgcttggcagttggcatgatagcttgattcagtaaagcattggcagtaccagcacggttgagactatcgagattgctaaatgttgtccacgggcctttatcagtggcaagttctgctttcgtaaaaccaggctcgttattgttgacggtaatctcggcagtgttgttgtaattgagctgcgccagttgcgtgaccggttggcgcgaggtgccatccgttgccggcacactgttgctaactgaacttgattggggcggtgttcccagcagtgtggtgtgttgctgcgtgtaggtataaccgccgctggctaagccaaacaacagcaaggtcgccgccaaccgccgattcgcccgccgttgccgctttgtgccttttcgcagcaaaagtagcagcatgccagcgagaatgagactgaatgtgatgaggttattcatagtgccctccaagtgactgatggatgtattggatgagttagtccattgatgctatgaaaaacacaatgctcagttctaaggtagtcttttcaaggggtagagtcagggcggctagaaaccggtacctttggtgaacaggcttggatgtatcagggaaaattagtatgctatgaggtctgataaagtgaacgtatttttcaactaaatcatttaggtgacagatgctgtccttgcgagcctttaataacagaatacgccaatgatagacaaacagttttttgacctgattgcttataggatagttgactcagttatatagtcaccatcctagtgaatgatgtgttgtcctttagttttccgaagattccagctagtatttgatacatggaagatcattctctctctgcttttatcggcaacttaatttagagaagaaagtgaaactttttgacctctccttatggatttattatttggctctatcgtgctatcaaggaaaactcgatacgaacacaggcagataattaaagttattagtttttgatcattatttagaatactaagttagatcctttaaccacttgtcgatcctatgattgagctgggcgagaccgtcccgatccatcggcagcttgctgacgatggtgggcaaatcgttgaggttggtcctgagatcgctggcgtttgcgtaataaggcaattgcttcaagttgttgtccagttgatgcaaggcaagattgatggacaccgctaattttgaagctccccttattgatcgggggcaagccgaaaattaatttggggacgccggggatcatgaaaaccaaccacctcactgcgaggccgcaaaagtgtagaattgaaggtacaatttacttgcagcgactttaagaatttccttttgaatggtaagtggttcagttgctagacaattggttatcgcttccgtgtcgctcccccctcttaactccccacatgaggatgggtcataattctcgcattgaacttgtgattcatgagattccgaataatctgggcagggtctaggctaaagaatcctttgccgctccaaaatccacaatctctggccaggtggggcttgcaccgctgagcaagggcggagacggcgcttcgagtccaaaacccggtctcgaagtcgcctaacaacatcagctccaagtcaggtcgctgtgttgtttgcacggctgagtcccatctggcttaagattgctccgccttggcgctgatatctttaaaactctaataaattacccatatgaatatgaaaaggcaaaacaatttccgcagaagtcgtttgccttttgtttgataactgtgaattgtgatccatcctcatggacacagattgataagacgaccgttttaattctttttcaaagaattaaaacacctgatttgtcttacctaaatcgggacttagaactatcaatgacaattagtcaacatcggattgtgggatgtatcagtataagggggattcaatgctattctggttacgagcggttctaatacgacggaaatatgaaattagggaaatcaagacaataagaaccactagggctaaagagcacataatgatgcccatggaaaatgttatgcgtggattattcaatgagtacgcagtcgctcctgtggtaactgaaacagattgcagataggttgtgggtaacagttccccaatctttttaagcggatcaacggtagaggttaataaaaataatccgatagtggaaataagagagatgaacaaggatgccattttgtttttagcaatagagcatatgagcatgacgaaaactagaatgaataggcttgatatagcttggagacagaacgaaggcaggaggatttgatacaaatcattgaacttcattgacattgttggtaattcataaaaaagaacagggtaatttaaactgccgaagccatttactatagttcctgtagataacgtaagtaaactggtcataagcagtagtaccgaacttactatccacgtaatgcctatgtgccacatgttgatgacgagttcaagttgggggatcaacaaacttacattgattcgtgatctatatgattctccaaacagattaaccgctatatagactgatactaatgtcagaagaacaggaataatgttttgccatgtccataaaaagaagccagttccgttggctgaaaagtcttcgttgtatttttgcacatttcgtttctttagagcaagaaagcggagtctctcgcgttctattgcattctctaaaggcttgcgagtggggtcggtagtttcattctgatttagctttttatccatatcaatggtttttagccttagagcatatgcttgagaccactttttagaagccaaatatttctgaatacttaggtctcgtttcaaaagcttttgggataacttaatatcgttgcggcgcatcgccttttgttggtcgctgaaggaacccgaacgtatttctttctcaagaacagcgatccctaacttataattcttgatttctttggcgatcgtgctctcgaatgaaataacctttgacgtttgattgttgaaataaaaggttatacccacgcaaagcagcaccaatccgatgaggaccatgctcattggatttttgtatattttcttaatatcccataagccaacatttgtcttattcttcatagagtttttggtcctttagcgtaaacatgtggtcagtaatatccttaacgtcgttaagatagtgtgaagatagtattatagtcttgccagctttttttagggagagaagctgagaataaagaagctttctggagctttcatctaggccgttatttacctcgtcaaaaattagaacgtctgcgtcactgactatatacattgcaattagtaacttttgtttcatgcctaaagaatactttgaaatttttaaattgatgaaatcagacatttgccacttggtgatcacatcggtcaataggatttctgatttccactgtgtctttacaaatcttagatagtccaagccattcaagtgtttatctagccaatcagacgtttcataaaaaaagaaggaacgtctcattttacttagaggttgctttaggatctcaaccttaccagaagatatcggtattaatcccgttagcgcacggaagatagttgtttttccagacccgtttacggcaattatcgaatatattgtgcctttttcaaatgtgtaggtaaatcccgttacgatcgggaatcgtgtttttaccgatagattagtaactgtcatcatcagacgaaaggcctccgtataatttaaaaagaggcagagtcgcaataaagcctctgcctccaagtgtcaccttaaaattaatatccaccgtgataatgccgagtgttttgataccgaatataattccatccgctaccgatttgataccagtcagtgtttaggtagtaggcgctggccggaatggttttattctgaaaatcaaaatctgtgtttttctttgtgtagatattgtaatcagacttgaaccatttctgaaccaatcgccatgaatctgctcctactgggttagcagaagtgaatgcgccaatcccaacaaacataaccagtacagctagtacgttacgtgctttcttcatcgtagaaccccttatttaggtgcgttaatgagatgtgccagttgatacaagaaaattatctcatgcatcaactagcaatgcaattaaatttattgaatttaagagataacgtgggttttatgagcgtttaataactatattatagttgttgttatttaaaaagtatctattaattcttaactatattttttctataaattaatatatttaaaaaatcgtttaatatgttttagcatgatgtgagatgaggttacttatggaaaagacaataaagcggtttgcaagtgacttgagacctagcaagcaaagcatctagtactgctaccaaagattaccaacgaacgacaaaaggataaccgaaaccgaaatattgacagcgctgatgtagagtggcttatacgggacgaggcagcaaagcttttgtcaccaaaaaaccactaaaaaacagcaaagagactgacaagtaccgccaaagagcgacaaggagaatctgctatgaagggcgcaatcgtgtatttgagagctgaccgtgacaaacaatttaccgccaaagatttgcaaatagaaaaaacgcaaaaattgctggattagttgcagcagcgtaactgatggcagagcagaagctcaagccgctggaggtgtcttggaaggagccagaggtgcttctgacgactaaggcggaaggtaccgtagataacgcaaaaatgcttagtgactcaaatgagacgagagcgcgttaggagttttggacccgattatttgggacaaaaagtaacaaatgaccaggtacaatctaggtggattttcactaagtctttgtggctgggttgctgctgaaataggtagttggcaactaaaccgatgagatttcacaaaattcagctttgcggccttatcaggtcggggttggcgagctacttctgatagtgggcactatgtcaactaggtgaattccataacggaatccgcctttttaatggtcgattttagatcgtgaagtgcttctggttcgtgacttcttgttggcgggtatcaagcacatagtgatacaacgcgaggagaacatcgtgatttgcctgatctgactcattgaatgctgaatccatgagttcctgaaggtcggtacttttgaccgcttcaatacggctgcaatggttacccggtcactacattcatggatttgtttaggcatacgtacacctcatgaaatgatgatgatcctatcatgctgtcagcagcttagcgtgattgcgtatacttcatagactggaactcggttgcaggcatcagacaatgcttagctggtcagtctcgtttactagctcctcaataacgtctgactggcgtatttgtgaaacccccaaatatctgctaatatatgtagaaatcttttaagcgaggtataaaattgctcacagtaaacaatgtatcaatgacgttctccgaccgtaagctatacgaagacgttaatttgaaattcacgcccggtaattgctatggcattattggcgcaaacggcgcgggaaaatcgacttttcttaaaatcatccaaggtgaactgaccccaacgaccgggacggttagtttgtcgccgaatgagcggatgagcagtctgcgtcaggatcactttgcgttcgacaatcaaacggtgatgaacactgttttgcaaggttgggaacgactttatcaggtgatgacggaaaaagatgctttgtatgctaagccagacttctctgaagctgacgggaataaggcagccgagctggaaggcgagtttgccgaaatggacggctggaacgctgaaagcgacgcgtctcagctgttgcagtcattgggcattgcggaaagtgagcaccagaaactcatggctgatctgcctgaaggggagaaggtcaaggtgttgcttgcccaagcgttgtttggcaaacccgacgttctgctgctcgacgaaccaaccaacgggcttgatccgcaagcgattaactggcttgagaactttttagctgactatgaacacaccgttttggttgtctctcatgaccggcatttcctgaatgcggtctgcaccatgatgtgtgatgttgacttcggtaagatcgaactttatgtcggcaactacgatttctggaagcagagttctgaactggccttgcagctgcaaagccaagcgaatgccaaaaaagaagaacaaatcaagcaattgcaggaattcgtggcgcgtttctccgccaacgcttcaaagtccaagcaagccacttcacgtaaaaagcagcttgaaaaaattacgttagatgatattcggcctagcacacggaaatatccgtacatcaagttcgagccagaacgcgaaatcggtaacgatttgttacgggtcgagaatgtttccaagacaattgatggtcatgaagtactgaaaaatgtcagcttcattttgcggccaggtgacaaaacagggatcatcagccgtaatgacgtgaccgctactgtgctgatgcagctgctagcaggtgagcttaaacctgacaccggcaccatcacatggggtgtcaccaccagccgtgccgctatgccaaaagacttgaatcctgaatttgatcatgatgatctgaacattctcgattggttgcggcagtttgcgccacaagacgaacaagataacacgttcttgcgtggcttcctcggtcggatgctcttttctggggatgaagtgctcaagcaactgaatgtcttgtctggtggcgaaaaggtccgttcgtacttggctaaaatgatgctaagcaaggcaaacgtcctcatcatggatgatccaaccaaccatcttgatctggaaagcatcaccagtttgaacgatgccttgatcgacttcaaaggctcattaatcttcaccagtcatgaccatcagttcattcaaaccattgctgatcatattatcgaggttgggccactcggtgttgttgaccgtgcggacacaagctatgatgaattcacgcaacacgaaactgctcaggcacaggtagccgatatttatccggctgataaaaagaagtcaaaggcgtaattgccgatatcaccttgaacgttacagcttgtgacatcatacgcagttactatacaggcgaacaattttccgcagtcagggaaattgttcgcctgtttgtttgctcatggatgacttattggaatttataaagatcccagtgccaaggcggagcaatcgtaggccagatggaggcgaagcgccgtctccgctctagctgcgcatcgccagcccagctggccggagattccggtgtttgcacggtaggggactcttgcatagagcttttctgcattgtttggaatctagcacatcataattgtttgaattttagaattcttgctcatctctacttcaattttgtttttcaaacccatctgatagataatatcagcataagtaaccgacaagataagtgtgtgtgacccgcgcaagttgttattgaaagtctcaccaatctggtcacatcagctaagaaagcagtgatcaatatgtcacaacccattacgattcttctcagcgtcaccggctttattgttgcgatgattgtcctcaatggtttgttaacctggcagcgacagcaaaagctcaagcgccaattgctagctgactggggcacttttcctgaaaaacggccaaaaggtgagcgctatttaaaagccgcctatcttgatcatgaagcccaagttaatcacgattgccaagttgacgacctgacttggcaggatcttgatatgttagacgtgttcgaacagctgaacgtcacccaaagtagtgttggcgctgaacgggtttatgcacaattgcgggcttatgatttaggcaaaccagctgttgacgaggcgttgattgccttttttcaagatcatcctgacagccgattgaaagtgcaaatggcgtttgccggacttggcatcgagccggcgaacaatagccaactttatctacggacaaccaccaaaaaagccttgccgaatgcatggcgattcaaagtaatgggcggttttccatttatcggtgtcttgttgacgctattgtggccggcaattggggtgaccttgatggtggtcagtttgctggtcaacgtgttctactacattttgaaacgtgaaggccttgatgccgaaattacgtctatgggttaccttgtccggacgattatcacagcagaacgtctcgccaaaattagccaaccgactcaagcagcattgcgacaagcagttaaaccaatgcgcggcatcacgcgatttgcgtttgtcttccggaccaagaccggcagcatgggcgacattttaactgagtatcttagcattatgttcatgctgagctttattgcctacaacacagtgctcgatcgcttaagcagccaccatgctgaggcgctagccctgtggcaacggctgggcgatttagagttggccattgccattgctaattttcgcacggcggaagcgactacaacgcagccagtttttgctaaaggcggcatgaccgctactgacttagcccatcccttgttgaaacatcccgttgccaacccagttgactggcagaaaaatgcgttgatcaccggtgccaatgcttccggtaagtcgacctacgtcaaaagtattgcgatcaatgccattttggcacaaacgatcaataccgtgacagcgacaagtttcacgatggagccgggagaggtcatcacggctatggcggtgcgtgatgatctgagtgaaggcgatagctattttgttgcagaaattaaagccattcggcggctgctcaatgctgttgccaaaaagaaacgcgtctatggttttatcgacgaaattctaaaagggacgaataccgtcgaacgaattgccgcttcagcgagtgtcattaattggctaaagcaatatccgagtttggtcgtggttgcgacacatgataatgaattgacggacattatgggcgatcaatgcgtcaactggcattttcaagagaaagtgacgaaggaggatggcgttgtctttgactatttgctctatcaaggcctggccacttcgcataatgccatagcactgttggcaaccatggactatccaacgtccttaattcacgatgcgcggcagttggctgcggattttgaacgtagcaaagcatggcctaagtttgttaaaggagggattcaagcgtgacagatgcagataaaatatttgaggctattcgtcaggatcccgataacgctgactttaccgcccaaggatgggatccgctatatcatattgaacctgaagcaacgatcctcatcgccagtcaggcaccaggacgaaaagcacaaacgacaaaaacatactggaatgatccaagtggtgaccgcttgcgaacttggatgggcgtcaccaaggatcagttttatcacagcggtaaaattgcagttttgccgttagatttttattatcccggcaaaggtaagtcaggtgacttgccaccgcgtaaagatttcgcggccaagtggcatccgtctttgttagcgttaatgccaaagattcaacttacaattgtgattggtgcctacgcccaaaaatattatttaggaaagcatcgcgaaaaaacgctgactgccactgtcaaaaatttccgggcgtacttacctgactattttccaattgtgcatccttcgccgctaaactatggttgggtcaatcgcaatccatggtttatgaccgatgtggtgccggcattacaggcgcaggttgcggccttgatgaagtaaacgaacgttctcgcactcgcacaaaaaagctgagatcatggcagagttgatgccgcgatctcagctttttaagtagccttttgcttgaataatttaatgagtgattgaacttatggtaatgtcacgaagatgagtgcgccaacaacgccgccagctaaaggaccgagaacaggtacccacgagtaaccccaatcagagccgcctttatgggcaatcggcaggatggcgtgcgccaagcgtgggccgagatcccgcgccgggttaattgcgtaaccggttgtcccccaagtgacaatccgattgcagtgatcaagataccaacgcccatcggagctaaacctgctgtccatttgccttgcgcaaaagctaataggccaaaaatcaagacagcagtgccgatgaattcagacaagaagttagcggtatagttgcgaatggctgggccagtcgcaaaaacgcctaagatggttgcttggtcattggtcttcgtccaatgtggatagtaatgcagccagacaacggcggctcctaagaaagcaccaagcatttgggcagcgacaaacggcagcacccatgaccaagaaaattgaccgatggcggcaaaagcgatggtcaccgccggattgagatgggctgggccaaggaaagccgcggtataaacgcccatggtgacagctagtccccaaccaagggtgatggcaacccagccagcatcctttgcttttgattggttgagtgacacgcccgccaccacgccgtcaccgaggagaatcaggatgaaggtgccgataaattcacctaatgtttgtgtccacatgttgattcctctttctattcaggatgaaccggtgctggtgccgtttttagataggccagttgactgtcggcaatggcagcattcaaggcggccagttgttgggctttcaccgagtcgtcccatcccagtgtttgcgccatttcgtcaacaaccggctgtttcaactcagccagtgtttcagcgtggaaaagtagggcattggttcggcgcaagagataatcaaccggtgtgagcgtcatttcctcattgagtgaataacgtagactcatggtttccttcagacttaatcctggcgcaggaccatcgacagcgtaagtgagcactcggctggtattggaaccgaagcggttagccagatcttgggcttctttttccgataaaccagcatcaacgccaatccgaatgtagaaggccatggtttcttcaacattggtcggatcaaaatgtccgccggaaacttgcagctttttggaatcgactgctggcgcgtcaacgttgaaacgatcgaccagaatacggcgaatcagtgcgagggcaccagcggccattttccgatagtctgtaattttaccaccggaaagggtgatgagcccgtctgtcgcttggtgaagcgaactgccgcgagaaacttgggacgggcttaatccggcttctgcatgtgctgtttccagtttggaaatggcacgttcaacatcggcgcgggttgcttgatcgtcttcataagcgttcacaacctcgatcaaggccgtgaatgaatcgtctgaaactttgccgctgttagcaccgccgccgttataatcggaactaccgttgtcgttgatcagtggtcgcaacccagcccaactagcttcaatatcgtcgatcgtcatatggctttcggggaagcgtttattgacgactttcagcagataatcgacatcttcttgctcaacgcggggatgttcataatcgccggtataatctgtatcagtggtaccaaaatacgttttgccttctcgcggaaccacgaagaacatccgaccatcgtttaagccagtatccatgtaagttggttgcggaactggcaagcgagaaccgtcaacgactagatgaacacctttggttggccgcaaagttggcgcgtgtttttcgtgatcgtcaagtgcattgaacttatcagcccatggaccggttgtgttgatgaccagtttggcatggatatcgaattcagtgtcgtccaacaagtctttaacatgcagcccaaccacttgaccagcgtcattgtgcagcacgccgaccgctttaacatggctggccatcaagccgccaagttcgtcagcttctttgatgttttcgatcacaaggcgtgcatcgttgttgacgaaatcgagataaacgccaccgccttgcaggttatcagcggacaattgtggttcacgttgaaggacttcatcttttgtcacggtataattggcgtactgagaaccttcaacaccagccaatcgatcatagagatccatggcaattttgacgctgaacatgtcaaacgtactgccggattcttgataaattggcaacagcattgggaatggccgcgggatatgcggcgcgatcccttgcacgacggcgcgttctttaacagtgtcagcgacaacgccaacatcaaaagatttaagatagcgaataccgccgtgtaccaatttggtcgaacgcgaactggtgccttccgcaaagtcctgcatctcaatcaaaccggttttgatcccgctggcagctgcttgaatcgccaccccagcgccggtaatgccgccaccgacgatgagcaagtcgagctcggtatgctttaattgatgaatcgtttgtttgcgcgtttcgttggaaaataccattttgttctccttcattacggatcgagtcagtctcgatcattttttggttgatagatcaagctttcttcgccttgtgcttatacatttgggttgcagcaacagcttgctgccagccttcataaaggtggtcgcgatcaggcgcgcccattgttggttcaaaacgtttgccaagcttcacgatactttgcagttcatcggtattgttccagaagccagtcgccaaaccagcgaggaaggcagcgcccatcgccgtcgtttccaaattggctgctcgttcaatcggaatgcctaaaatatctgcttggaattgcatcaggtaatcgttgttagctgcgccgccgtcaacgcgcaaagcttggatcgggataccagtgtctttattcatggtatccacgacatcacgtgactgataagcaagagattgcaaggttgctttgatgaaatcttcgcgagtcgtgccacgagtgatgccaaaaatagcaccgcgagcatcagaatcccaataaggcgcacctaagcctgtgaaggctgggacaacataaacttcattttgactcttagaagctcgtgcggcggcttcggagtcgcttgaacgctcgaccaacttcatggcgtcccgcaaccattgaatcgcactgccggcaacgaaaacggaaccttcaagtgcataggtcaccttgccatcaagtccatagccgatggtggtgagcaggttgttgttggacaaggtcggtttttcgccggtattcatcacaatgaatgcacctgtgccataggtgtttttcaccatacccggctcaagcgccagctgaccaaaaagtgctgcttgttggtcaccaaccatgccggcaatcggcacggtactgccgaagaaatggtaggctgctgcattgccgtaaatttctgaattgctgcgaacttccggtagcatttgcttaggaatattcaacaattggagaatctcgtcatcccaggctagtttatggatgttgaacaacatggttcgtgaggcgttggtatagtcggtgacatgaatggcgccgccggacagcttccaagaaagccaagtatcgatggtgccgaaaagcagttcgcctttttccgcccgttcttgcgcgccaggcacatgatccaaaatccagcgaatcttagtcgctgagaaatacgaatcaattagcaaaccggttgaatcatgaatcatatcgctgtggccatctgccttaagtttgtcagcgatctcgctagtttgccgcgactgccagacgatggcgttgtagattggcaacccggtctgtttgtcccatacaaccgtggtttcccgttgattggtaatcccgattccgacaatttggcgtggttgaatttgtgattcaataaacgccgtcgcgatggtcgacaaagcggcattccaaatttcattggcattatgctcgacccatcccggatgcggaaaatactgcggaaattcccgctgtgcatcaacaactttttgaccattgtgatcgatgatgatggtccgtgtactcgtggtaccctcatcaatcgccagaatgtacttctgatcacttgtcacaaataactaccccctgtgaaataatattgcacacaatgaaaacgtttccagaaatagttataccgtacctcgtgacatcctgtcaactttaaacttatgtgtatcattagttattttaaaaagttaaaaaattgatcaagattctgtaaatgagatggaaatggaggttgtgctgcaaatgagatatcttgaacaaaaaaacgcgtggccgatgaacgttttcattagccgcgcgtattttgcttaggatcatctgacatgctattggatgagctggcgcatgcgatggatccgctcaaaaatctggtcttcctgacggcgatcagcccaagaaaaattgtgcatcgtactgtttcggcgattgaccttcgtgtacaaaatggttggattataagcatatttgccaggcgtatgcgcgacaaaatccgccgtgaagtaatagtcttccgcaatgcgcaattgttcatcatagcgaatattaccggcagttaaggcatcacgagagaaagccttgttccaaatataaccgcccacttcggagccgtggcgtgagacttgatcaaacatttcacgctgtgacaacaattgaaagcgattaggcccgccgcggctgcgatgccaccaatcataaccaaccgcagtggccacaacacccgatgtgaacccatgcgataacgttgcgccaaaggccggcgcgattaaatcgtcaccgtcaacaaacgccacagcttgaccagtggcatgatcaatgccaaagtttcgcgcagcaccgatgccacgatggtgattaaaaccggtcgcgtgaaaattagggatacctttaacaaaatcagccactgtctgagcggtaccatcagtcgaggcatcgtcgatgagccaaagttcaaaatcaattgtttgttgctggatactttttaatgtctcaggcagataatgacctaaattgtaagttggcacaacgatggttaaatctaagttcgacataattgcctccttgaagctcgttttgatcattatcgtcaaattacaggtgacgtcaatcaaaatgattcatgtatgaagttgggttgttgacatggggaatgctaactatcggcgccatgtggaagggacattctgaacctgctagaatttttagtaaaaggaagttgctttaaattcagcgatttttaaatgaccggtaaaacaaaaacaaaaaaatttggctatagcgcttccaatccgtcattatttttagtaaaattaaaacggttacaaaaatcagtagcggataaataagcttaacttcaattaggaggtattgacggtgaatagtacagatgtcacgaaaggttttacggaacaatttggtaagcaggcggagcacaccttcttcgcaccaggacgcattaatttaattggtgaacataccgattacaatggtggccacgttttcccgtgtgccatttcgctgggcacttatgcagcggttggcaccaatgaggacaacgcttttcggttatactcggccaacttcccaaaggttggcattattgacatcccattctcggatcttttccaagataagcgcggcttgtggacagattacttccaaggtatggcgcgggtgatgaagacggcgggtgcgaacttcacgcatggcctcaatgtttacatcaacggcaacttacctgatggcgctgggttatcaagttctgcttctctggaaatgctggtcggaacgattctgaacaatctttttgatggcggctttgaaccgttggagctggttcagttcggcgttaaagtcgaaaacgactatatcggcgtgaactccggtgtgatggatcagttcgcgattgaaatgggtcgcgcaaatcaagcaacgctgttggatacaaacacgatgaaatacgagtacctgccagttgagatgggcgataacgtgattgtcatcatgaataccaacaagcgtcgtgagttggctgattccaagtacaacgaacgccgcagtgaatgcgaaaaagcactggcaatgctacaaaaaggtattgaagttaaaagtctgggccaactgagtgaagacgaattcgacgagaatacttatctcatttacgatccaatcctgatcaaacgcgcgcgccacgccgtctttgaaaatcagcggacattgaaggcttcgaaagcactgcaagatggcgatttgaagacctttggcaaactagtctctgcttctggagtttcgttggcttttgactacgaagtcactggcatcgagcttgatacccttgtgaccaatgccttgaagcaacggggtgtgctcggtgctcgcatgaccggtgctggctttggcggctgcgccattgcgattgtcaacagtgctgatgttgaagactttattgataatgttggcaagacttatcgtgaaaagatcggctatgacgcccatttctatgtggccgatattgccgatggtgctaagcaactgaactaactctgctaaaatagaaaaagtgttataaagtagagcgtgagccagaccgatttctagtctgacgaacacgttttaaaaaagggagatattttattatgacaattgcagttttaggcggcgctggttacatcggttcacatacggtaaaacaattactcgctgccggcgaggatgttgtggttttggataacttgattactgggcatcgtaaggcggttgatccacgcgcccgtttttatcaaggcgacatccgcgactatcattttctgagccaagtgttcagtcaggaaaagattgacgggattgtccattttgcggcgttctcaattgtgccggaatccatgaaagatccgttgaagtattttgataacaacactggcggcatgatcaccttgcttgaagccatgaatcaattcggcatcaagaaaattgtcttctcatctacggcagcaacttatggcgaacctaagcaggtcccaattaaagaaactgatccgcaagtaccgaccaacccttacggtgaaagcaagttggccatggaaaagatcatgcattgggctgatgtggcttatgggctgaagttcgtggctttgcgttacttcaatgttgcgggtgcgatgccagacggttccatcggtgaagaccatcatccagaaacgcatattgtgccaattatcttgcaggttgcagcaggtacgcgaactggtttgcaaatttatggtgacgactatccaactaaggatggtaccaatgtgcgtgactatgttcatgtggtcgatcttgctgatgcccacattttggccttgaagtatctggatgccggcaataagtcatccgcgttcaacattggttctgcgcatggtttctccaaccttgaaattctaaatgcagcgcgtaaggtgactggccaagagattccagccacgatgggcccgcggcgtgccggtgatccaagcactttgattgctagctcagaaaaggctcgtgacattttaggctggaagccaaactatgacgatattgacaagattatcgaaaccgcatggaactggcacgaaaatcacccagaaggatttggtgaccggaattgaccgcgattagcaatcacgttggtaccattgtgaaactcaatcccgattacacccagatggatgcagtctatctgaacaacaaattgttgaatttgatcggagatgctgcccttgacctgtctggtgatgctgatccattgacgaaccttgatctgatggtgaaagctgcgcaggagaatggtaaaattccagattcacaggcagcacgtcagattttggaagcgcagctgatggaccttgctaccccgacaccaagtcggatcaatcaactgttttgggataagtatcaggcgggaccacgggttgcaacagactggttctttgctttgagtcgcgcgaataattatattcaaacgcgagcgattgctaagaatgttgtttttccagctaaaactgaatatggcgacctcgaaatcaccatcaacctgtctaaaccggaaaaagatccgaaagacattgctgctgcggcacatgccgcccagtctggctatccggcgtgtgccttgtgtttacaaacggaagggtatgccggtcgaactgactttgcggcgcgaaccaatcatcgcattattcgctttttgcttggcggtaaaacatggggattccaatattcgccatatgcttacttcaacgagcacgcgatttttctggatgctatccatgaacccatggtgatagaccaaagtaccttcagcaacttgttgtccatcgtttcaatgtttccaacttattttgttggctcaaatgctgacttgccaattgtcggcggttcgatgctgacgcatgaacattaccaaggcggtcgccatacatttccaatggccaaagcaccaattgagacgcaggttgaaattagcggacatccgcatgttttcgctggcatcgtcaagtggccgatgagtgttattcgcttagtgagtgctgattcggacgagttgataaatgcagccgaacatgttcggcaggtttggaatcagtataccgatgaaacagttgacgtccgcgcatttgttgatggcaaaccgcatcatacggtgaccccaattgctcggcgcgttggttcggaattccagctggatttagtgctgcgcgacaatcaaactagtgcagagtatccggatggtattttccatccgcatcaagacgtgcaacatatcaagaaggaaaacattggcttgatcgaagtgatgggacgtgccattttaccggcacgattaaagtcggagttagctgaagtccagaaatatcttttgggtgaagccaacacgatgaaaccaatgcatcaagcatgggccgaccaactgaaagcaaaatatgattggacgccagcaaatgcagagatacaaatgcaggcagcggttggtcgtgtatttgccagggtcttagaagatgctggtgtgttcaaacgcgatgaagttggtcaaaaagcatttgctcgcttctgtcgggcactgtagcaacaggctacgttgctgaagccggcaaggagtcaatggaaacggagaaaacgatgaccacgattaccgatattgcgaaggcggcaggggtttcaattgcgactgtctcgcgtattttaaattatgatacgacgttggctgtcacgcccgaaacgcgccaacgcgtgttgaaaacagccgaaaagctggcgtacaaaccacgtcgacgtaaacgtgtgtccccgcaaaccaccgttgccttgattcagtggcgcagcgagcaagaagagttgaatgatctgtattatttacagattcaatatgctattgaggcacgggcggcctcagctggctatcatttgcagagcttgcatttggagcagttgggagccgagacgacacaaaacgtccaaggtgtgattgcgttgggtaagtacgacgctggcgaagtggcaacgatcaaagccttggcgcaaccagttgtttttgtggatcaaaatatgttggcatttgactgcgattcggtcaccagcgattatgccggtcctatcgagcaaattattcatcattttcaatcggtagggatcaacgacatcgggtttcttggtggcgttgaaacgagtcgcagcggacgcgagcagtttcaggacgtgcggacagccgcgtttgatcgggtgatgtacgcagagaatttgatgcagccagcgtttcgttttattggcgcgttcacgcctgattcaggttacgaactgatgaaacaagcgatcaccaaactcggtgacaccttaccgcacggtttcattgtggccaacgacacgatggcagtcggggcgttgcgcgctttgaacgaggccaagatcgaggtgccgcaacgcgtctctgtgatcagcttcaacgatgtggcggtcgccaaattcacgaccccgccactttcaacggtgcatgctgccactgaccaaatgggccaaaccgcggtcgaactgttgcaggcacgcatcaaagatccgaaacgcgtaccacgtcaggttaacttcaaaagtgagcttattatgcgagccagcagcttgtaggaacggtatcataacgtgttcccccgcgaagaaacctgtccataatgacctcaagtgcaacgaccaaaagcgggtcatcatacttgaggtcagctgatgctctggtttctaaccgcgctggcttacgctcgtttataaaggaggacaagatggacgtttcagttgaaccatacggtcagtatcaaggccacaatttgtatgagctgaccttgaccaatgatcaaggcatggttgtgaagttgctgaattatggtgcaaccttggaaaaagtgttgttaccagaagctgatggcttgcacaacatgattctgtcactaccaagtcgggaagattactcgaaagagcgcaacttccttggtggcacagtgggtcgaattgttggccgtattcgtggtcatgtttggcagcatggcgatgtgaaagttgatctgccaatgaacgaaggcaagaatcacattcacggcggcgatgacggactggatcggcaagtttataacttccgtattgaccagacagctaccacagctagtgctagttttacttttgttgatccagcagggcataatggctatccgggcaacgtcaagctgcaagtgacttataccttggagaatacgaataccttgcattatcgtctggatgcagttagcgatgaagaaacgctcttcaatccaactaaccatacctattttgcgattgaccagccaaacaaaattgatgccaccacgctgacgattccagccgacgattacaaaccgcttgatgcagaccatctgccagatccaggctggcagccagttgccggaacggtctttgattttcgccaagggcaaaagcttggcgatgtcattcacactcgagcagcgcaaatcactgcagaacggggcattaatcacccattcctactgaaacacggccaaaccctcgcggccaaactccagactgacaaacatactatgaccctggcaaccactgcgccgtccgtcgtcgtttacaccgccaaccactttgacggtaccggtattcctcacaacattgatcaatttgatggcgtggctcttgaatgccaatttgctccggtcagcggcgatgatctttcggcgatgacattattgccgggcgaaccatttacgttggtgaatagttgggcgtttgaataggcagcttaactttttaatgcctcgggatgttctgaacgaacctaatctttataaagaaagaagccttccaaatcattggaaggcttttttgacgcaacgagaaaagtttagaagttcttgtgttaagctgcttttttggttagcattgtgaacaaatagtttcaagttaatacataaatggttacgcggtcaaaagacatgcaatgtgacaaaaggagtcgatagcatgaagacaaagtttcttaagttgccggtctatcaacaaggacttttcttaacgttgatttggctaatggtcgggattggcgtgatgctatatcgctggccaacaagtgatcaggattttcaaacaaccgcctattggcttgcaccgaatttgattcatatgcaaggtgaggtgaccgctcaatggttcccgttttcgtgtgcagtgacggccggtgtgagtctttatgtcgtcaagcatattaaaagtagaaactgtgacactaaagaaggcctttatgtacttcagaatttgtggcccatctggttggtgataatcgtagtatttttcttattaaatctttggctaccacaaacagggatgactcgtttttcgagttttgatcgacaagtactcacgattgcaatactgtttcttgatattactttatttagttcttacatgctttggttaaacttctgggtgccggttggccgggtacataatgtcattaaggttctattttgggcagtgcttttccttggagctggatttattatgagccactttcaatttacgtttgccagcagctcctttagcttggacgatctaggacgacgtacatggttaacactgccattttggccaagctggtttttaggtttactattaacggcggttatttggtggcacacttttcgtcgacttcgaatgacggatgattctcactaaaatagagagaccggccgtgctcacacaactcagcaaaaagattgagggggtctaactgctgacaagcgtacaacctagtcgggcgaaccaactatccaagatgaacaatcaagccttaaaaaaacacgctttttgtaaaagtaaacgctttcaactataatttagatagcgatatgaaccgtttacgtaactaatattgaacgcgtaaaaatgttaattgggcggcaattagggaaggagactttctcatgaaaatgaaattgcaacgcctaccaattgcactacaaggcatcgttctaggcgccatctggtttttgcttgctatagcattcatgctgtataacactccgactgcaaaaaatgaagtaccaatcccctttccaccacttgtaccgcagatgtttcgagtagatggtgttgtaacagctgactggttacagttcattttctggttcattctttttctcacgtggtacgcgatctatcgggttgtcagactaaatgaccaaactcatacgcttcaaccggtgctgcgagcggtcgtaccaatatgggtatttgcaattacaatcgtctttatcgcaactttctggacgccgataattgggctaaacggcttgtcggttgttgaacgatccttagtaacactggggttactagttttcacagttctatttgtgggtgcatttcggttgtatggtgagattttacgttacagttcgagacaagggaaagttttcagaataatttgctggtttacacttctttgcgcgtcattctatgtcatatggcatctacagttcaccgttcaaggagcgcccattttaaaaaatacgttcttgttcggtggtctcagccaagacgcttgggtcgtacctttttggccaagttggctgattggcatggcgctcatttccttaagtttgttttttattaggaaaaaaacaatcaacattcagtatcgcgaagaatcaatgtagccgataaaaattgcaatatatataaataaataagtttcaaaatcaatagccgacaatctaattgtcggctatttgtttaaaattgttcttttatgttgtatccaaggaaaatagtattgatagagatttcgactttgcaaagtcatcctgtcggcttaaaggtggatagcaacgaggattagagggaggctgattttttataaattaatttgccaacctgtcaaagattttcttgactcctgaaagcgtttaaatataataaagagtgaacagaaataaacattaattaacaggagtgaagagaatggctgaggcggttgagaatgacctttttgattcaaaattagtttttgtcgaggatggtgaggatcaggatacaatctttaaacaagtttctgaccgattgttggcagcgggtgccgttaaaccggacttttatcaacatcttagcgaacgcgagaaaagctatccgaccggcatcgatatgagcgttgtgaatcccgagtactcgaatgtggcgattccgcatacagaaggtgaattcgtcaatgtcagaaaaatcgttccgatccgtctcaaaaagccgatcgaatttgcgaacatgatcgcacctgatcaaaaactcaaagttagctttctgttcatgattttgaacaatgatcctgaaggccaagccaacgtcttggctcagattatggatttcctgacaacatcgtctgcggaaacattagcaaaattgttcggcgcagatgatgcggcaacgatttacaacattttggcaaccagttttaaaaaataaggaggaagtttgttatgacagttaagattttggcagcttgcggcgctggcgttaattctagccaccaaatcaaagatgcaattgaaaaggaatttaagaagcgtggttataacgttcaggcagatgcagtgatggtcaaggatgttaacgaagatatgatgaagaactatgacatctttacaccgattgctaagacggacttgggtttcaccccagcaattccagttattaacgctggcccaatcttgtatcggatgccagcaatggcgaaacctgtttacgacaaaattgaaggcgttatcaagaaggaaaatctgaaatagtctcatggtctgatggcgatgaaccgtcagatacatataaggagtgagaaaattcatgcaaaccattattgatttggccaatgcggtcttcaagccagttattgatttaggggcagcgccgattatgctgatcgtgctgaccttaattgcttgggcggttggcgttaacttctttcatgcgttggaaggcggcatcaaacttgcgattgcgattactgcgatcgggagtgttatcggtttattgacaaccacctaccagccggcgttaaatgctttcgttaagtctacagggatcaatctttcaattactgacttaggttgggcaccgcttgctacgattacttggggttcaccatacacattattcttcctagcaattttggtaatcgtcaacttagttcttttattcttgaatcggacaaacacgttggatgttgatatctttgatatctggcacttatcatttactggtttactggctatttattttggagcgaacctgtttattgctaccattttggttatctttatcggcattttgaagatcatcaattctgatctcatgaagccaacttttaacgacttacttgacgattgggaaaacccaatgacaaccactcatttaaactacatgatgaatccagttatcatggtgtttgataagttatttgacaagttgttcccatggttggacaaatacgactttgacgctgcaaagcttaacgaaaagattggcttctggggcagtcgtttcgccattgggatttatcttgggatctttattggtttgatttctcatcagagtatcaagtcaatcgcgacattggcctttatggccgctacctgcttggagctgtttagtataatcggttcatggttcatcgctgctgttgaaccactgtcacaaggtgttactgattttgccaacaagcgtcttggcggacgtatgttgaatatcgggcttgactggccattcttggcaggccgtgctgaaatctgggccgctgctaacgttttggcaccaatcatgctgcttgaagcactggtattgcctggcaaccgcattctgcctttaggcgggatcatcgccatgggtgttaccccagccctgctggttgtgactcgcggtaagattattcggatgatcgttatcggtgctattgaactgccgctcttcctttgggcaggcaccctctctgcaccatttatcacacacacagctcgcgcactacacgcgcctggtattcctgcaacagggctcttctcttcctcaactaaggaaggtccaatcgaacaattcatcgctgttcttgttggtaaagcttccaagggcgaaatgatgatggtattgtacgctgcactggcattgattgcttataccgcattgttcttctggtatcgtcacgaaatgatgaaacggaatcagaagtactctgatgacggtaaagaagttgctgacgatgttaagttcgttgcaacacacggtgctgcaggatccgcggactaaaattcttaaatcttttaacttacagcttcatcatgagatgcataaagagcctccatcgtttttgatggggctctttttgtttcatcaatggtaaatagacgttattactttttgagaaacaagtagaaggacattttaaagaggcacaaaaaaagtcgcgatggctttcgcaactttacgtgctgattgaaaaaaatggctgaattgatttaccggcttgcccggttttcacgacgctttttacgatcaaagacatggtccattttgagtagctgatagagggcatagcaggcggtgaccatcactaatacttgtgtcaatgagtttttaaaaataccgtttatgattgctacgaatgtcacaagggccaaccacagtaagtaagtttttctacgtgccgtcatcagattacctccattggcttttgaataactctattataccgcagctaaagcgctaacactagtcaaaaaagaactaaaattaacaatatcgaacaggcaacacagctcgtattattgaggctaaataaggttgcgggttaataggcatcacttgcattgaagtggtaaagcacggagaactaaaagcaaagaaaaataaaaaagctcccactgcatccacaaaacgcaatcggggcttctgtttacttgaaaaatataaagctgttacagtctaataaattgaattaaagtcttgctccattctcaatggggggactaaccacgttctttcgatgaatggcgtgagtgcgatgtcgacgtgggctggtggacacgttaaagtgacagggcacattttggatgctgtctgagttgttaacataggcgcattcggccattgtaacttagtttaaatgcttcacccgaacgagttcgccggtgacgccaacttgaataccttgcttgatcttgtctgtccgacttgcatggacgacttgaaacttgttttgcttaacgattagcttgttatcagtgtgatagtcggctggcaatggttggttgctgccgcgcacaagcatcacgataaacttgaagccgctggcatgtgcttcgcaagggctgtaatgaagggtgtcactgaagaattcaacaaccgttccagccgggacgaagaaaagcttcgcgtctttttcggcattgaattggtcgtcgtgcatctgtccgcgcttaccgatcaccatgacaacatcggtgaagaaaacgttcacttcactgccttgatggaattcaaccgcagtcaaagcttccgcgtggccagcacattctcccgcttcaattggcaagccggcgtaaacatcacgaccaatttgctgcaccacaggaatcttttccatgtcgggatttgacgggacatagagattggcttcgctaggggcggggatggtgacatgctgatccatgaaggttttgagctcactgacgtcatactgggcgtaggtgacaccatagtcggcaaacgctgcctcatctaagctgtggatggttttatctggattaagggttcttagctgatcaatggttgacatagatggacttctttctgaatgttaataggattcaattgttactttggcaaaatactcatcaaacttagctggattgacgaagccggtttctgcttccatggtgttcaacatcccggttgtcatcgccgttttcatgatgtcttcatccgatttgccatcatgaatgcccatggctaagccagccaatgttgagtcgccggagcccacaggattaacgaccttaatctttggaatggcagcgtgatagaacttatccaaatgttttacgaaggcaccagccgcacctagggacacgactatccaatcgacaccatcaaaaatcgggtccatcagatcgtgtttcaaggccgtgtagtcggttttgtcaacatcacggttgagcaggccgccaagttcttcttcgtttggcttaatcagcaacggtttcacaggtgcttctaaagcggattttaaagtggcacctgatgtatccagaagcactttgacgtttttttgacctgcatgggcaatcatctgggtgtaataatcagccggtaatccttgcggcatggaaccggagatggtgatcaaatcacttttgtctaacaggctgtcaaaatggctgagaaatttctcggcatcttcggcagcaattgttggtccggcttccagaatttcagtctgttcaccgccatcatgtaacatagcaatcgaactgcgggtttcggcatcaatcgggaagaagtcatggtcaatgccgtcgcgatcaagctgattttccaaccacttgccaaaatagccgccaataaagccagttgctgtaatctcgtgatttaacatatgaatgacgcgagatacatttaatcccttaccgccagcagttttccgtaccgttttcacccgattgacggtgtcgattttgagatgttcgagcgggtaggagacgtcaatggatgggtttaaagtcactgttaaaatcataagtattttcctccaaaaatgtgatgatgagctgggtcggatacaaacctaatcacggaagacgttataaaagccgattccctgaggagtcggcttttatcgtcttcacgcgaattaggcgtgttcgaccttgtccgtccaaggagttgccgtttcagctaagaccttgtttaagcgatcgatgtttgctttgccttcagtttgcagccatgctttaccagcagcttcgccttcagcagcaaatggtttcacgcctggtttccaagttgcccggccgcagagaacaccgttgaaggttgaacctgcttgctttgcaaatttcagttcttcgaggaacaattcgtttgaaacgccagcagacaggaaaatgaatggcaggtcggtggcgtcggattgggctttgtaatacttggcagcctcctccttggtgtaaaccggggtcacgccttcatctgtgaagccttcgacaaacttctgatcaactggaacctcgacttttagaacagagacattgtactgtggtttgctgaattccttggtgatcttgatcaccttatctggctttacctttgcccatgcagccgtcccagtttcattgagggtgccatcgtaggaaaccagttccaagaacaatggcaaatcgttagcctttgcttcggcaccaacgcgttcaacgaaagcatacttgcgatcattgatggcgtcaggttcgtctggatcgatataaagcaagaatttaacggcatcgccgccttcattcttaatgcgcaacgcactttgatcatcaatcagatctggaaaacggccaggttcggtagcatcataaccggtcttttcatatgaaagcagcaggccagcctgaggggcacggactttggcagctggcagaccatattccggatctagcagaatggaactagcgtatttggttaattcctcagaaacagcctttttgaaatcaacgatggtggtttcatcagcaggcttgttggccgctgccgcaagcatctttttcaaggaaccgcgttgatcaatggccagagcagagatgatgttgttgtcatcggacaattgttgcaaatgtttgtattggccagcagtaagggtgacagtcatgtagaaattcctcctaagaaatagtgtcgaagtgataattagtcgtggtagacgccttcagcccacttttcgagttcagtatcgaagaagtgcggattgtctttttgttctggatttggcttggcaatgttatcaattttatcgatgattttcttgttctgaggggtttctttataggtggcatccagataagctttgacaatatcttggatcatatggataccaaccgtggcaccaccgatgcccaatacattggcatttaattgttcacgtgcataaacagccgaggtcacgtcatcacacatagctgcacggatgccgtcgtttttgtcagcggcggttgaaataccgataccagtaccgcacatcacgatgcctaagtcagcgcggccgtcagcaacatcttcggcaactttcttaccataaataggatagtgggtacgatgggtgtcataggtaccttcatcaatgacggtatagcccatatcttttaacatgttcgaaatttcaattttctgcatcgtgacgatgtgatcgttaccaatagcaataatcataagtgtgaagcttcctttcttcttttaggctgtaggcaaggggactaaatcattttttcgagcatgtcgaggcggatttggtgacggccgcctgcatattcggtgtccagataacgttggatgatcacaagtgcacgatcataacctgtgatgccagtgccaatagcaattgccttggcgccattgtgttcggcggtcatatgggcggtgttttcttcttcgacaaccgcggtgaccatgcccttgactttatttgaggccattgctgagcccataccgtaacggtcaaacatgatggctttatgtgcatcgccgctcaacagttcctttgtaacagccaaagatgaatcaacaaaatcttcagcaggttctggggtcatatccttaacccgatactgatgatcctctaaatattttttaacttgttccttcattgcgaatccatctttgtctgcgccaataatgacatccatgttcttattctcctttatttgttttatctgtgatgacatgtgtgaacgtgttgtaatgttgaagatcatcgcgactgatgcccggatcggtaatcaagccatctgtctgatcaagatcatagaagctatagaagtcttgccgattcaacttgaaatgatctgcgaccacaagtttcatgcccgcattgtctaaggcaatacgttgtgtctggccttcttcggggctagcattgctgatatgattgtccgcaataccgttgacactgataaatgctttcgtggtggtgagatgtgctagcatttcgtttgctaagctgccgataaatgcgccagatcgagcccgaagccgtccgccaattagttgcagtgaaaagaaatccgcgcgatcctgaaagctttgaaaaacagggagactgttggtgatgatgcgcacatcgggttttttgagatattgtgcaatcatttcgttcgtggtcccagggccgatatagatcgtgtcgcctggtatgatcagtgcggcaattgttgcggcgatttttcgcttttcattcacatgaattgatcgcttttcatttcgggataattcagtcagcggtttaaagttggtactttgggcgccgccatgaatgcggactaactctttttggtcggcaagctcttccaaatcccgtcgcaccgtcatcgttgaaacaccaaggctttccccgatttcgttgacagttacaatacccttgcggtcaactaaattacgtattgtcagtaagcgctcgtcttttaacatatcctcacctcgcacgtgtgttcattgttgtttgattttgtttcttattacattgttcaagttaccaccgagttcaatattcgtcaagcctataaatacgatgtctattaagatttcatttgccttgatgataattgatagagatcacaagaaaacggtttacaatgaacaaacaaatataatgcgacatttaaccaaacagaaaacaacatacacacacataaatctgttttcacgaacggtttcacaaaaatgcttatgctgggtgacctgtgtcggatggctttttagctggtatagatgagaaattcatggcataaattcaaaaagtaagtttaaaaaaaaccgccaatagttgcatgtgcgcacgcaccctttggcggtttttggttggaaattgtggataaacgtcattttaacgtagtatataataggaacaacacgtcaagctaaggttggcaaagtcagcaaatcacttgcctgttgtagcaccgcaacccgaggcattacttcattacttggcggcgtggtccaacctgcaagtgcaaaagcaaccttggcgtcggcagctgcctgtgcatcagtcggtgtatcaccaatgtaaatcgttgatgctggctcactgcccaaacgttcacgtgcgagggtgatgggatcgccaaagggtttgttgcgtttggcctcgccagcaaccacgatcgcgtcgaagtaaggactaaaatgaaactttttgtcttcttcaatgaactgcgtcttgtcttttgacgtcactaggccaagcttgtaggtttgtttgagctgattgagcgcatgctgcataccgggaaaccaagcaatgtcggtgaggaattccttcgaatcttctcgccattgctcatggacttcaggaatttctgcggcactgaatccgagttccgcgaggctgtcaacgcccgcacgcccattggtccaggttaattcatgaatggggacctctcggccatggcggcgtaatgttttttgtaagccatacaaatacgcctctacattgtcgagcagcgtaccatcgatgtcgaagataaaagtgttcatgatattcctcccaataaagataattgtagcaagtaagcgataacaaggaaaggcataacgatgagattcttacacacagccgattggcatattggcaaaaaacttaatgattttgatttgcttgaggatcaacaagctgtgtttgagcagctggtggaaacggctgagacgcataaagttgatgctattatcattgcgggggatctctatgaccgcgccttgccaagcgaagctgctgtttccgttctggataacatgttgattaagttgaatcgtgaccacggctatccgttgttggtcatttcaggcaaccatgactctgcggtacgcctgcgcacaggtcgggcatggtatgccgctactaaaatgtttgttaatacccaagtagccgaagcttttacacccattgagttggatggcgtgcaattctttttgctgccgtattttgaaccctttgctgttcgtgactattttcaagataagacaatcacgaatgtggctcaggcaattcgcccgattgtcgcgaaaatgaagactttatttaagccagatatgcgtcatattctggttagtcattttttcgctgctggaagtgaccatagtgcttcggaaacgaaagttaatgttggtggactggacgcggtaccgctggatgatttggcagcatttgattatgtggcactagggcatctgcacaaccatcatgctttgcatggtgaaccaaagattcaatatagcggtgctttgttaaaatatgcggtcagcgaggcccatcaagaaaaaggggtctatattgtcgatactgagaccatggatcgtgagtttgtgccgttgaagcctaagcacgatttaatcgagttaaaagctagttatgccgacttgacggctccagcatactatcagcagcaggatcgagatgcctatattgggattgatttgaccgatacgcaagtaattcctaatgtcatggcgcaattacgccagatttatccgcggattattagcctgcgccgtgagaacggtgtgaatgccgtcaagcctttgcaagagcggcagcgtgatttggatccgatgagtttgctgcagactttttttaaagatatgacacaagatgatttgtcggccgcccagattaagtgggcgaaggcagggttgacgacggctaaaaaggagcaggcataatgcaacttaaacaattacacatgcaattttttggtccgtatgcagatgcagtcgttgattttgacgattttcgcaccagtcccttattcttgatcagcgggccgaccggcagtggtaaaaccacgatttttgatgctttgatttatgccttgtatggtgaaacgtcaggtgagcgtgacggtgggcaaatgcgctcaaattttgcaggtaacagcgatttaacaaaggtgacactcacctttgatcatgatggcaaacattatttaatcgagcgccaaccgccgcaattgcaaagtaaaaaacgcggcgatggactaaccgaagtcaaagctaaggtgttgctagctatctcctcagatgaaaaacaggtggctgagtaccgtaagaaaaatcaagttcaggaacagctagacgccgttttacaccttgatgcttcgcagtttcgacagattgttttgttgccacaaggcgattttcgccgcttcttagatgctgatagcaatgcgaaagaagatctactgcgtgacttgttcggtactcagttgattcaacgttggcaaaccgctatgttggcgcagatgaaggccaagggagcagccattcaggaccaagagcggatgttagacgttttgatgtcgcagtttgacttcgagacggctcctgacgagcatgctacgatggcggataagctgtcattgatgagagcaacggtggcgagtcaagcgaaagttgtgacagcaagacaagcgaccgcggcgcaaagtcaccaacgatatcaggaagcacaaacggcactgcaacaggggcaacaattggcgcaggcttttacagagcgagaacaagccgccacagctttagcaaaactggcggagcaaaaacaaacccatcagaagcaattaaaacaaattgaacaattgacatgggtacagcaacatgaaaatgctgctcaacgtgttcaaaaggctggacaagatcttaaagcggcaattgtgcagtctgaacaaacgcaagcagctttaacgacgaccgaacagaaattttctctggacaagcaagctttagcacgcttgcaggccaaatcagaccagattgaggcccaaaagaaacaactgaatagtttacaggctgttcagcaacagttgacagccatcgccgaacaaaataaacaggtgattaaacaagcagcgattgttaatgaggctgagcttgcgttgacgcacgcacaacagcagttgacagacgcccaaaccgttaaaacacagcagcaaacaagtctggataacttgggcttggatgagctgataaacacggtcaatactcagcgcaacttattggctgccttagtgccacaggctgctaattatcaggaagctcaagctgatgttgcacagttgtctatggccatcaaaaaaacccaagttacgctggagcaagccgaaacgcaggtagcagccacaacctcgcatttgaacaagcttcagcagactcagattcgccaacaaattgcacatttggctgctaagctcgagcctgacagcccatgtcctgtttgcggcagtactagccatccgcatccggcgcttgtggttgacgaaccattggtgagcgaagcagcgttgaaacaagccgatcaggaacggcaaaaggctgccgcaagaaaaactatggtcgagacacaattggcgaatcttgaaacccaactgaaaactgcgaaggccaaaactgcacaggcaaggcaggcttttactgagcattggcaagaacaggccaaactgattgcaggcgttgcggataaaactggtattttacaacaattaacggcgttgaaaacactggcggcaactaacgagcaccagttaacggaagcgcaaacggagcacgctgctttgcaagttgcgctaaaaaagagtgacaaggccatcactaccggtacgacaaaagttcagcaatgcgaagctagtttgaacacggctagaattgatgcggctgaagcgcaaagtgcgttgaagaccatgcaaaagaacctgcccgcggaagcgacggatttggcgacggtcgctgctcaagctacaaccctgcagacaaccattacaacgtatcaggctcaacttcaggaggcgcaggcaagggtcaatgctttggatcggcaattagccgggttgcaagcagacgagaaacacgccgcggcacaagtgactgctttgaccaaggaacaggcggaagcaaaagcaacctttacgatagcagtcacgcagtattttggtgctgatggcaagcaacggttcgccgagttgcaactgcgggtatcacaattaccgctattgaacgaacaggttcagacttatgagcatacacagctcaagcaacaaacgttattagatgccgccaataaaactattggtacccaagcacagccacagcttgatcagcttgaggccgaagcaacagcagcggaaacgacagcaacaaacgaccaaacggctttgattaagattagtcaggcgcatgatgctgctgaaaaattggccaaacaagccgccactatctttacggccaatcaaacggcgcttgcagcctatgcggatttacaaacactggccactgtgatgaatggcaatggtcccaagaaactcagtctggagcgatacgttttgcaggcttatttgcaagaaattctgaatgtggccaatagccgtctgcaggttttgtccaataaccggtatcaatttgttttgcataccagcttggggacgcagaagatccactctgggttggaaattgatgtttacgatgatcaggttggtgagaaacgagctgtgcagacgctatcaggcggtgaaagcttcatcgctgcccttagcttggcgctggctttgggtgaagtgattcagcaggaaagcggcgggattaatattgatgcattgtttgttgatgaaggcttcggcagccttgatgccaatagtcttgatgtggcgatgaatgcgttagaatcattagaaggcgaatcgcggctaatcggcatcatttcacatgtgaccgagctgcgggataatattcccgatcagttgcaagttgagccagcaggtacgggccgcagtcgcttaaagatccttcactcggcttagcacttttaaattgagtgtgccaagtctacgtgaaagtggtataacagagattgtaagggtcaatcctacgaactcacaccaaaaagaggcgacatcacatggcatcattgagcaaagaacagaaaaaagctttgatcgctaaagtcgaaaaggagcgccaagaccatcccgaaaagaagtcaaagaagtctggcttcgaaacgattgacgaagaagcagaacgccttgaaagcgaaaattaatgttagttgagtcgctggtcctgaacagttaactgttcagggcttttttttgcagagcgcaaaccggcccgcttagaaaccgaagcataagtggccccgaacctaaacggcagggctttggtcgtttaggttcggggtccttatgcgtaggtttctgggccggtttgcgcgtttcggagttcagcaatatcaggcagggctttggtcgtgtaggttcgaagcccttatgcttcggtttctgggtcggtttgcgcgtttcggagttcagcaatatcagacagggctttggtcgttttacgttcgaagtccttatgtgcaggtttctgggccagtttgcgcgttttcaaagatctatagcccaatattcattttcgagacagccagatctgcaacttttgcgccccagtgacagtaactgtctatgatggcaaggacggtatttatcgccattaagctagcgcttttacccatgacgccgcatactagtcgtgtctattgagcagttgccgcaatactaagacttttttaataatggtctacaaagaaattaaaagctataacgcatgtgagagtatgcaaagaagccgattaatcagcttttttcaaaaattattagcacttagcgttcacaagtgctagtttgtggtataactataggtggagcgagggagaaggaacaagagcttcagagcaaatgtgtttctcccgaatcgccaatgtctctatattgaaaggaagctatctgttatggctaatgaagttttgaatcgtcgtaataatgagttgatgaacaatgtgaatgatccgttctttgacaacttggcacgccggttcttcggcccggtatctgactggatggattgggcaacacctgccatcaccagcacggccgtcaacggattactgaccgatgttaaggagaccaaggacgcttacgaagttcatgtggatgtacctgggattgataagaacaacatcaagatgaactaccacgatggtgttctgagtattaacgttcataaggacgatatcaccgaccacgctgataagaacggcaacgtcatgatgtccgaacgtaactacggcacaatgagtcggagctatcaactaccaaacgttgatgcaagcaacatcaaggcagcctatcaggatggtgtcctcaatatcaccatgcctaagctgactgaatctaaggagtctggtcacaacattgaaattcaataatgttcgtcatcagttgacccaagatttacggactgcattgcaagcatgaatagaagcggcacttctgccgttagtgggcagaacccatgagtaagcaaacaaaaatcgatgagaattgccgcagttgcagtgatcattgagtcgttaaagtcatcccagcgatacgtatggtcgttggggtgatttttttgtagagcgcgaaaaggctcggttagaaaccggaacataagcggcctcgaacctaaacgacagggctttggtcgtttaggttcgcaggttcctgcgccttttcgcgcgtttcagagagccacaatatcatggctaagctttagccatttagattcaagctccttatgcgcaggtttctaggtcagtttgcgcgcttcggcgagccacaatatcatgacagggctttggtcgtttaggttcgaggtccttatgcacaggcttctggaccttgctcgcgcatttcagcttgaaacaaggattcccactcaccaacaaaagcagttcaatatttcccgattttcaagtccatggtaagctagtggttatgatgacaaacaaattaatgaactggccgccggaaaaagtggcggcttttcaaaaggccttattgaattggtatgatcaacatgcgcgtcaattgccgtggcgcgaggatcatgatccttatcatgtcatggttagtgagctcatgctgcagcaaacgcaagtgcagacggtgattccttattatgaacggtttatgaatcaattcccgaccgtgggagccttagcgaaggcgccagaagcagaggttctgaaggcgtgggagggcttgggttattattcccgcgcacgccgtctgcaacaggcagccaagcagattgttgccgattatggcggcgtttggccgcagacctcagaaacactgcagacattgtctggcatcgggccttacacagccggagcgattgcgtcaattagtttcggggaacctgtgcctgccattgacggtaacgcttttcgagttttcgctcggttgtttaaagtggatgcggatattgcccggccacaaacgcgtcagatcttttttgacttgattcagccactgatgccaaaagatcgacctggtgattttaatcaggccgtcatggatcttggctcaagttacatgtcggcgaatcacccagaccctgcacattctccggtgcgagattttgatgccagttatcgagatggggtggtttcggcttatccggttaaaacgaaaaagccacggccggtgttgcatcgttactttgcgttagtcattcgctcggagaaaggctatttacttgaacagcggccaagtactggcttgctggctgatttgtggatgtttccgctcgttgacatggcagatcttgaaagtaccatgatgagtgcgcagttagatgaggtcagcacgttgtttgcggcatcgtcagggatgcagctgacgtttgcggatcttggcgcgaaaacggttaagcatacttttacgcatcagcaatggcagttgacgttgattggggtcgaaactgcggcgagcgatctcagctttttaccagcacggtgggtgaaagcggatcattttagtgagctggcgttgccgacggtgcagaagaagttgaatgcagcgctggggatgaattagaaattggtattgggtgagtggcttagtgattttgaaacatgttcatcagctcagaaactgggccgtctcacccgctggctgaaacgtgcgaacaggcacagctcggctatgccgagctaaccgctccgcttcacgccctgagtcaattgcttacatttcgccgttgagcgggttatactgagtgcaaatttgattggagaggtgagcgttttgacagttaatgtaacaagagatatcgcttacggtgacgcagcattacagaagcttgatttttatgaaccagagaagtcaaatggggcggcgatcctcgacattcacggtggcggttggtttcgcggtgagaagaataaagaaggtgagatggctgaaaggtttgccgcacttggttatacggtggcggttcctaattaccggcttgcacctgaagccttcttcccagcagctcgtgatgacgttttagcagccttttcatggttgcgtgagcatactaaagggttgcaacttggcgtttttgggtccagtgccggtggttcgctgtcagttgacgttggcttagccgagggggtaccgacagtttcttggtcgggcatcttcgacattcgtcagtggttcgcagatcatccagcagtcgttgctcagccggatacgaaaaccgattttgtgaaaacggcaagtgcgaaaattgatcaaggtggtcgtaatgatccattttacaaatggttcattttgaattatgttgattcagatgaaacaaagttccctgaagttgaaccgtttgaccgtttgaccgctcaggcaggacctttgtatctggctaattcgcaggaagagattattccgattagcggcatctatcaattggcacatgccgctgaaaagcttggcttacctgtgaccttgcagtcgattccgggcggtcagcatgctgaaggctatcttgatgaagcgtggcagggtaccgttgcgttctttgcgcagtatttgttgaaaggataatcgtggaaacattagtcgttgtgagtcatcctgaaattgaaaaaagcgacactcagcagtttctaaaggcgagtgccgcttctttgtcgcaagtcgtgtggcatcatttagatagtcggctaccctttgatgtgacggcggagcagcaagcaatcacgtctgctgatcgccttatttttcagtttccactttattggtatatggcgccggcaagcttacatcagtggctgacagacgtttggctgaaacagtttgtttatgatgcgcgaggtggattgttacacggcaaatcacttggttttgtcgtgacattcagtcaaccggcgaccgcctatcagcttggcggtagcgttggttttagcatcagccaatttttgacaccatacgcggccttggcggctaaaaccggcttgacgttattgccgcctttgacaattgcccaatttgccaatcaaacagatcttgagcatcaacaattattggtgcgttatcagcaatatttgacgcttgaccatcctgaccgaccagatgaacaggcacagtggtttattgatcgattgagtggcaacgctgatacacaattgttggcggatcaattagcagcgcagacggatgacattgatcgcttacgtttgacattacacgaattaaaggcaggcgagtcggaatgacaacagatgaacaatggctagtgaacgctgctgcagtgcaggaaaaacaggcaacatcttatgaaaatgccgccttttttagggcactacaagcattcgtcacccagcaggcaaaacgtcgtgaaagtcttgaaggtgaaatcgatggccgcagttggaatcacgaacaatggtgaaagttcagtctgacgacggaggggaaataactcaccgtatgctatggttaagttagcaaaacaaaggagcctaaaaaatgcaaacaatgtttgatcgtcttcaacgttggtcatggctgcgcggtttgctgatgattttaatcggtgcctggattttaatcgcaccgcgccaagtctatcgcagctttatctggatcgtagctgcagtcttgattattgcggcaattccaaagctgattgacggcttttcagcccgcaaagcatcaggcacttacggtacatcgctttttacagggggcttttacctgttattggcgctgatggtgccggtcatcgttcggccactgatgagtctcgggccattgctgctgggcattgtcttgatgatttatggcgtcaataaaattttaagtgctcgaaatcgacaacaatttgtgaacgtctcggtttggccgaccgtcatttatggtgtggtgttgcttatcatgggcttcattatggccttgaatccgttcagaactgtcatgatggtcttctcattctttggtggcttactcgttgtcatgggcattttgcaactctttacgcgaccacgtgcctaatcactaaaaaaagcattcgacatctaaaaggtggggaatgctttttttctttgcctagatcttttgctggctgataggcagaataattgtattccaccgagtagatggctacactctgtgcaaaaggatctgacaacgcttaacatgcgtgcttagaaactggcctatacgcgatttaaggctgaagtcgtcgcctttctgggctggagaacacgttgaaggaggaaaaaatgatgcacaagtttgattggcgggaagttgaacgtgacgagtattcgcggtctgaggaacctagttttgtgaagttgacaacgcgcagctatatcacagcgatgggggtggcaccagatcgggtgacggatcaagccttcacgtcactggcagcagcggtcacccaaattgctgagcggatcagcgaaggaccagatgctggcattgatattccgagctttaaagcttaccatccctatccattgcaggcggtttggtcagggggcgataaaatcagtaagcgccacatttttcgattgtggttgaagcaaccgttgtttattcatgaagaccagtttgaggctgcactgacacagctgcattttgaaccagccattgcccagcagcttcacttagaacagttggcagaagggtttgaaattcaaagctttaattcaacaccactgacggatgaagcacctgcgattgcgcgtattcaaacagtgatcaaccgcgaccatctcgttcctaaatttgatgatcgtcatcgcgaggtttatttggaaggctatcaaggagaagtaccggtactttaccgggtgccgcttgacgaaaacttcggtgaagttggcgatgagcaggttgcatataattaatctgaatcgatggcgccatgaaaaagcgatcagctctttttaaaatgagctgatcgcttttgttgtcttaattagaattgtgggtagacaatcttattggcccagtgattgatcgggccgtactgatgaccgactgcaattggatgaccaatggcttgattggtgaaacgcttagcaatgcgaatggcttcctcaactgagttgcctttgccaatttctgcggtgatgacggcggaaagcgtgtcacctgtgccgttaacccggtcggttgcatgataaggttcacttaaccagaatgacttgccgctttccagcaaaacaaaatcacgcacagttggttgcgtaggatcatcatgggcaccttttaaaacaatgttcttggcaccggagtcttgtagttgatgtgcggccgcttcagtctgagcgtcggtgtcgagtttcataccggtcagatgctcggcctcgtaatgattgggggtgaccaccgttgctagggggatcagttcatttttgacagcatcataagcgtcttgttctagcaacatcgcgccgtgtttagtgataataacgggatcgacaactaaggcaccgaaatcatattgctgccagtttttgataatattttgcaccagtgcgcgatcggcaagcatgcccgttttagcagcgcgaatatgcaaatcagcagcgagtgacttgaactgggcatcaatgaacggtaatggcatgaccatactatcctgaatcccgtaagaattgcctgcaacagccgcggttaaaatggtagcaccataaacgccgcgcatgaagaaactatgcaaatcggcttggacaccggcactgccgtcactgtccgtaccgccgattgtcatcacttgtggaaactcattagccacgtgattccctcctcgtaaacgtgttcactggtgcagaagccggcacatcaggatctgaagcacactggccaaagctcagccaatgcgcttgaggtcgcttatgctccggattctaaccgcatcagtttacgctcttcctgataaaagactgtcatgacttgccaatactgttactaattaaacgcccgtttttgcggcaagacagctttaagccattcgccgataaatggatactgatggttaagttcgatgatctgcgtttctggatcaggatacttcagataaaccatattattagccggattgatcatcactgtaaagatcttttgatttggtagtggcaattcgtaaacgccagctttggcaccttgtcgcatgaggatagcgttgttggatgcaatgacgaataattcatccaatgctggtgaattactgcctgccgaaacacgaataatgagcttgagacggtgattgaccaattcttgcggcacagtagttgatgcccactcaaagcggtcatttttgacttcttcagagccaagatcttgccagtcgtggccatcttcgtctaggacttgatacccaagtacttttgcatcctgatctaatgacgtaccaatgctaaagtcgccggctttgatgactgccttttttgcaacgagtggtttgaggttatcaaaccgtgtcttgaaacttagtccgttaacgggttgcaagacagtttcatcaacagtggtgaagcgatagccgccttgattgagcgctttggctaaggcagacagtgccttaacggtttcggcatcgtaggtcatggcattgctgtcagcagcggtgatctgcaaaagtgtcggtaggttgaccgcttttaatttggcatcgtcactcaagggatccacaattgttaacaatgtgttgttgtcgtcctgcgtcgtctgaatcaccgcaatttcgctgtggtgagcatctgccgttgtatcctgcagccacaatgtctgcaaaaatggggtagggattgacgtcaagttttgcaatgcctgatataatttattgcccaagagattcgtgtagcttgccaataaggcggtcaatgcctcatcatttgattcccataatggcgagtttgctaaacgatcggcttcttgctgatatgctgtgccaatttgttggcgtgcctgagcaacggtgagtggttttgtaatcagggcagccaaatgtgcatcattaagattaagcatgcgtgcgccctccttcaagctttaatgactgcatgaaatcatccttcaagttagctaagatattttcaaattcagcgactgagctgtaagtccccatcactgcttggaattcatagcgcgtgatggctgcggaaacttcaagttcgcgtttgcgcttgtcgaaaatatcatctgcggtaagcttttccttgtcgaactgtgctttcagtcgcgaggcatctcctgaaggttgtgaaggtgatgcttggtcatcatcactcggatcaataaagtttttcaacaagccgcggaaaccgctgttgccttgggttgcttggccgcgctctggggcgttttcggcttccaagttgtcgatttgggtgtgcaatgaatcaacgtcacggtaaacctctttgcgcatcgcatccaactggcgatctagataatggtcgggatcgtcagaaaaagcttcgagttgtggtaggatgcggcgctgttcgtcagctgactgcgtgattgctcgcaagatgacgttaatatggccaaactcgcgtcggtggtaccaattaccaaagtagacggttccttgatcattaacttcaaaaaaggggatgtgctggcgcagaaaatcaataagaccgatctgcagaaaatcatgcagttccgcctgtgcgtttttgtcataagccaaaatataaccaggcgtttcttcgatgtctagccgcagattttcagcggttgcatctagtccctgataaaggcgataacgtgactttttatgccaagcatcggtaaaatcgttgaagaatttcttttgataagtaaggctagcttcaattgacatttaatatcctctcacattctatactaatgatttaagtgtaccgcataactggcaatataaggaagttttcttgtctttttcaagcccagaaggcagattcagccgtaaatgctggatacatgctagaatatgaacgagaggtcgttgcttcctataaatgcgctcgtcaatccagcaagttgcatgtaggcggattgacctgcgctcaatatgaaatgaggtaggcaaaatgaaaattgctgttttgggtgctactggtcgcgcgggcagtgccattgtcgctgaagctcggcgacgtggacatgaggtgctggcagttgtgcgtgatccgcagaaggccgctgatcggcttggtgcaacggttgccacgttggtgaaggaaccgttggtattgactgaagccgacttggatagcgttgatgcagtggtagatgctttgagtgtgccgtggggttcgggccgtggttatttacatctggactttgccacgcacttagttagtctcttgcgcaacagcgatacactggctgtctttattttgggaagtgctagcttggcgatgccgggtgcggatcaccccatgattcttgactttccagaaagtgccgcaagtcaaccgtggtatgatggcgccctttaccaatattacgaatatcagtttttacaaatgaacgcgaatgtgaactggattggtatttcaccaagcgaagcctttccaagtgggccagcaacgagttatgttgctggcaaggatacattgctggtaggcgaagatggacaaagccacattacgaccggcaacatggccttggcaattctggatcagttggaacatccaacagcaattcgagatcgaatcgttgtgcgcgatgcggattagatgcttgtgcagcgattaaaaaaggcgactttgcaacttcctgaggcgatgttaggaagatcaaagttgccttttgccatttttgcttggtggactattaaagatggtaagcgagcctgctttcgctgaaacgggtaaattagcccagaaatctgcacataaggacattgaacctaaacaaccaaaactccgccaattttgcaggccctcgcacacgcgttcgcagaaacctgctttcgcgctacacaaaaaaacccgcgtattgggggtacgcggggtttcctgtcaacaccattgggggtggtgccgacttctttttactttggaggagtaaaaatgaaaaaaagttgggttggggtagtagtaagaagggggtaaacttccttgctacatagaaaagaataatctgtaattgtgaattttttatgacgttctggaagaaaaattttgaatgtggttttttaatgttctttgctactttttgatattgtgagcaaatgttattgaattttaaatggtcaaaatgtcaattagttgaaaatatgtttatataaattgacaaaagctgttgtgattgaagccttgatttctcgggcgaaacttaaatgaatgaattgcgaccgttttaagcgttaatatcgttatcttaaggtataataagtgttccaaaaaaacatggcaaaaattttgccggaaaagaggtaattttgatgggggtggtagtatctaactttcatctggcgaagatcacagctgaagaaaaagtgaaactaacttctggaaaagatttctggacctctgagcatcttgccgataaaggtataccaagttttcggatgagtgatggtccccatgggctgcggtatcaggcactggcagcggatcatctcggaatcaatgatagtgttcctagtaccagttttccaacagctagtgctagcgcagctgcgtgggatcctgatctcattcaagcaatgggtaaggcgattggattagaagcgcaaagtttaggcgtcgatatggtacttggtcccggcgttaatatgaaacgcaatccactttgcggtcggaactttgagtattttagtgaagatccattcttggccggaaaacttggcgctgcgtggattaatggtatccagtcgcaagggattgctgcatgtctcaaacattttgcagcgaataatcaggaaaatgaccggctttcatctgattcgctggtggatccgaccgccttgcatgaaatctatcttgaggcttttcgtattgctgtcacagaaagccacccagaagcggtcatgtgttcctacaacaaaattaatggcacctatgcaagtgataatctgtatttgatgacccaagtgttgcggcaacaatttgggtttggcggggcagtgatcacggattggggagcgttgaatgataaggttgcggcgcttaatgccggtacggatttagaaatgccaggcgacgatcatttatttgatggtgaggcgctgcaggcttatcaacaaggcacactgaaattggccagcttagatcgagcggtgactaagattgccgaaattgcccgcaaacaacggcccaaatttcagggatcgcgagagcaattactgcaagcaaatggacaattggcgcaaaaaattgcggaaagtgcgattgttctgctgaaaaatgaggccgccttgttaccattacaggctactgatacagtcgcggtcattggtgagctggctaaagctacacgcttccaaggggcagggtcttcgcatattaatgcttccgagatcgtttcagttttggatggccttaagcaaaaaaaggtgtcatttgattatgcggctggctatcgacttgacgatcaggatgattcgcaggcgactgccgaggcattagccttggcacgcaaccatgacaaagtcgtttttgttgctgggctacccgacaattatgagtcggagggctttgatcgccaaaatatggctttaccaaaagttcaaaacgatttattgcaggcagtgaccgcagttaatccaaacgtgattgtcctgttagtagccggtgcaccggttgagcttccgtgggtggatcaagtcaaagctgtcgttaacctgtcacttggcggtgaacgtatcggggccgcagctgccaacgttttgacaggtgctgtcaatccaagcggcaagctggctgaaagttatccgctaaaataccaagacgtgccctcagcggatgtctatgataaaaaccctcggtcggtgccgtatgttgaaagcacatatattggctaccgttattacgacaaagcaaaagtgccagtcgcctttccatttggttttggtttgagctacacatcgtttgccttgaaaaacattcggctctcaagtgatcacgtaaccgatgatcagccactgaccattagcctgcaagtgaccaacactggacaggttgatggtgcggaagtggtccaggtctatgttcaagaacaacaaccacgaccattacgaccggaaaaatcattaaaggcattcaaaaaggtttttgtcaaagctggacaaaccgttaatgttgctctcgagctgaaggcacaagcctttaaggagtggcgtgaacagacacaaacatgggtcttgcctgaagctcaaaaggcgattgctgttggtaccagtgtcactaatattgatgctgtcttaccagttagcttcacaggggaaacttttaataactttgcaacgattccaaattggtatacaacgctttccgggaaacctagtgttcaagattttgaacagttgacagaccagaaagtaccggcaccacatgaatttgtaccaggcgaattcactcgactcaatacaccgcgagaaatgaagaaacactcattgttgctgcggctagtggcgtggatcacggtcaaaattcgaactaaagattatatcgacaagcaaggacccgaggcgaagttccagcaggcaatcgtattggacacgccactcattcgcttggcgcaacaggccagcggtgcattaaagttaagcatggttgatcgactcgtagctgcggccaatcatcagtatgtgaaaatgatttttagataacagatgtattgtaaaatcattaaaaatttttcttgacgaatgacgattggattcggtatgctgattctcgtaccaaacagatagcgtgtcagcagacgtgatttatgcgactgcgaacgcgtgtttaaaggagtgttgaccatgaacttagtacggcaaacacaacttaataactttttcggcggctttttcggatagcggtttgcagtgagatgcaaaccgcgcaagcagtggtttgcatccataaggccgtcacattaaatgtgcacacaacgccgcatggatgaacaattatccatgcggcttttctataccgaaaaatctcggggccagtcgcatggtgaaaaccagcggctggtcctttttgcatcatgcgactatgttgaccgttccggatggctgaattgtcactcgtcactcatcgataacgcgctcgccagcgcagcaaccgcgctggcgagcgctcacaggaggatttttttatgaaaaagcatcggctacttgttatcgctactgcagcactggttggcttaacgctgatcggctgcggcaaaaaaagcagcgccgccagttccaaaaccgttaagatcggtattttgcagttgattgatcaaagtgccttgactgaggctaggaaaggctttgtggccgagttggccaaagccgggtacagtggtgatcgcgtcaaaattgattacgtcaatgcccaaggcgaccaagctaatctgaaaacgatgagtgatcgtttggcaagtgataagaatgatgtgaatcttgcgattgcgacccctgcagcacaagcactccaacaagctgacaaaaagacaccgatgttattcaccgccatcacggatcctaagtcagccggattggtcaccaatcccgcaaaaccagataaaaatgcaaccggcgtgacagatttagttgcggtagccaaacaaattgacctgcttcatcaaactttcccagaagcaaaaactgtcggcctcatgtataacgctggcgaaccaaattcggtttatcagatcaaacaagccaaagctcggctgaaacaactcggtttgcgttaccaagttcgtacagcggcgacaactaacgatgtgcaacaggccgccgagagtttagccaaaagcgtcgatgccctttatttaccggccgataacgttatggctgccgctatgccgaccattggcaaagttgccaaggctcagcaaataccagtcgtcccagccgcttcgaccatggttcaagacggcggcacgatcaccaaaggcatcaactaccgcgaccttggcaagcagacggccaaaatggctattaagctcctaaaaggtaaaactgttaaaacattaccagttgagaaaccagcaaaagtcgaaacagttcgcaacgaggcaatgctaaaagccgtcaaacaaacggttaaattaccagaataactgctatagtaacgttccttgacattcttccccatacaaaaactgaaatagccgaatgtaagttttttgtttgtgttgacaagatgagaatatgagtatacgctttgagacaagtcagagagaacatctctgcatgaaggagtgttgatcatggatcgagtcaaaacaacacaacttaatcattcttattattacggctatttcggataatggtttgtatctcatggatacaagccaatcaggtttgtatccatgatggccgtaagtgtttaacttgcaattaaccgccacatggacgaattcatccatgtggccttttctttttccgggaaaaaacaatggccagccacatggacgaaaaatccagtggctggctatttttgtaagagcgcgagtcagcccgggtagaaaccggagtgtaagcggccttggtcgtgatagtcgtattttgaccactgcgaccaaggtccttacatgtaggtttctgcgccagtgagcgcgtttgcacaaagtgtgaagcaccatcaccttaacccgtacatcccaggaggaagaaaaatgaagatcaaacgaatggccgctattgcggcagcagcactcactatcatggttttagccggttgtggtaaatcaaccagtgcagcggctgacaagagtcaggttaaaatcggcattttacagttgattgaccagcaagcgttgaccgcggcccgcaaaggcttcactgaagaactggccaaagccggttacaaaggcaagaagatcaagttggactacgtgaatgcccaaggcgatcaatctaatcttcagacgatgagccagcgcttgcaacgtgataaaaacgatctcaacttggcgattgctacaccggctgcccaagccctacagaaggcagacagcaagaccccattgttgttcacggcgatcacggatccaaaagcggctggtcttgtgaccacaacagccaagccagacaaaaacgctacaggagtcacagacatggtcgatgtcgctggtcagatcaactttttacacaaagcctttcctaaagcaaaaaaaatcggcttattgtttaacgccgccgaagaaaattctcaggttcagatcaaacttgccaaggcagctattaaaaaactaggtttgactgcggttgaaaaaaccgccgcgaccaccaacgatgttgaacaaagtgccactgcactgatgaaacaaagtgatgttgtgtacattccaaccgataacacgatggcggcctcaatgccgaccattggcaaaatcagcacgaaagaaaacattccggtcgtcaccgctgacgcgacaatggtgaaattagccggggtggcgacagtagggattaattacgaagacttaggccggcagaccggcaaactggctattcagattttgaagggtaagaaagttaaggagctagctgttgaaaaaccagctaaaacccgattggtcactgatccagcccggatgaaacaattcggcctgacagaagcggcattgaaacaagccgaataaccgatttcgtctcataacgcgctcgccagcccagaaacctgcgtgtaaggacctcggtcgcaacggtcaaactacgaccatcacgcccaaggccgcttacactccggttcctacccgggctgactcgcgctcacttaacaaaggagcttttcattatggacatcgtgacatcaagtattgcccaaggattactatggtcggtcatggcgattggcgtgtatctgactttccgaatattagacattgctgacatgacggctgaaggcagttttcccttgggcgctgcgattactgctcatgcaattgtcacgggggtggggccgattgcggcgacgctcatgggctttgccggtggcgccgcagctggtgcagtttcaggctttttaaccaccaagttgcatattccagacttgctcactggtattttgaccatgaccggattgtattcggtgaacctcttcatcatgggcaaggctaatatcagtttgattgggactgttaagacggttttcaatctggttgacagtggtgatgccacgaccaccggcatcatcatcggtgccattgtggtcgccattgtgataggtattctggtattctttttccataccgagatgggcttagctgctgcggcagtcggcaacaaccagaacatggcggcggccaacgggatcaacaatgatgcgatgaaaattatcatctacatgctgagcaatggcctgattgctttatcaggcagtctcatggcgcaaaccaatggctatgcggatttgtcgatggggattgggaccatcgtcattgccttggcagccattattatttcggaaatcctattgcgcagcgtgccgttatgggcgcggttgttgatgatcattgtcggcgctgtgatctaccgcctgattattgcggttgtgctggatcttggtgtcgacccgaactacctgcgtttcttctacgccttgatgttaacgatcttcctgtcattgccgttactgaaaaagaaattgcaactcatgacaattcgtcacggtaatcggcgtcaagctcgcatcgttcaggcacagatgcaagcagcaaaaaccgattcaatgcgcacacatgctggtgatcagcaaaaggaggtttagccatggccgtacttgaagtgcatggactgcatcagtattttgaacaaggaaccgtgaacgagaatcacgcgctgaagggcattgatctcagtcttgaacgcggggagttcgtcgcgattattggtggcaacggcgcaggtaaatcaacgttgctgaacagtatcgctggcacgctccctgttagtcaggggcagattttgatcaacggtaaggacgtgacctatcaaaatgttgctaagcgggcgaaggtaattgctcgagtctttcaggatccgcgttccggcaccgcctcgttgctgacaatcgaacagaatttggcattggccgaaaaacgcggctcttggcgtaacttttgggccagtggggtcaaacggagtgatcgccaacattttaaggaaaaattggcgacccttggattgggccttgagaatcgcctgggtgccgaaatgggcttgctttctggcggtcaacgacaagcagtaaccttgctgatggctactttaaaagaaccggcgttgttattgcttgacgaacacacagcagcgctcgatccgcagacaagcgctaccgtcatggctttgactgataaaatggtgcgcgcgcaacatacgacaactttgatgatcacacacaacatggccagtgcactgaaatatggtgatcgcttaatcatgctggatcatggtgaaattgctgttgatgtccgtggcgaggaaaaacagcacctgaccgtcgaagacttattgacgatgtttaaagaacgcagtggacaagagtttgctgatgatgctgttttgttgagttaaagctggcctaaaagaagttagtgaatagattctctatgagaaaacaaaagacgactgatttccgtcattggaaaatcagtcgtcttttggtggctatcagttgtccttcaaccgtgtttggttgaaggacaactttgatggttaaaaaatcaagcatgttcgaaattagtggttaattcataactgatgccagtaaaaacagatactcagcagctggcacttttccattagctcatgtccacaatcgtccgggttgtgtggtggttaaagtgtttcgtcaaggtttgtggcaagtcagctagtttgaccgtatcaacaggcattggcgccaatttgcccaatgtctgccatgcggctgctcgggccgcagcaggggcattgacggaatccacaccgagcaagctgacattgcgcaaaatgaatgggaagacggtcagcggcaaggcagttcctgcagcattgccacataacgcgattgcgccgccataacgcatacttggcagcaaactggttgtgaacgatccaccgagcggatcaatggcaaagtcaaagcgttgcttactcaaagcctttcccttgggcagttcgtcaagtgctaatgttgccgtggcgccaagtgacataacctgtttttgctgatctggtgtccgcacaataccgattcgattcgtgaagcctgcttgctctaataagcgcatggcaacactgccgacaccgcccgttacgccacccacaagaatctgcggtgcatgctcaggcgtcatgccgtgcgcggtcaaagcagcgacacataaggcagcggtcaaccccgccgtgccaaaactcatggcgctagcaagtgtcatggctgatggcagcgagattgcccaagaagccggaatgcgggcatattcagcgtaaccaccgccttgactgacccctagaccatgaccggtggccaacacttgatcgcctactttaaaattggcatcttgactggctaccacagtcccacttaaatcaatcccgagaatctgtggataatctcgaataatttgattctgcggttgataggcaagcgcatctttgtagttaatatctgaataagcgaccttgatcaataaatcgcctgctggtaagtcatcttcgtgcagggtttgaaaagttgccttttgcccatcgtgaaccaatgcttgaaatgtttgcatagaacaagcctccttggatggtattcttccacctattgttggtggtgaattgccatgctcattagttaactaaagcatatcagataacgatgatatagcaaaaccaacgttattctgccgaatctgataaggtggcctgacgccatggcgctaattcgtgccgatgttgacggcgcttgtaagtttcaacaaccaacattggcagccagacggcaccgaggacgatggcccattgtccggctgttagtggcgctagctgaaaaatttgttgcaatggcgctatggttgctaaggcaacgatgactgtcatcgtcagtaaaaggctaccagtcaggatcggattgacagtcatcgctgaccagttaagccgaccacgggttttgatggggaaaatgtccagcatcgaaccgatggctaatgtcagaaatagcatggtcatgccgatacctggcacatcggggctgaccacgaaacggccaacgaagtagatgccaagaatcaagccaacataggtggtcgtccgcacggccacacgtttgccgaggccattgctgaaaatactggctgcttttggaatgggtttcaagtgcatcatgccaggttcagccaactctcggctaaggaagaagccgggaataccatcagcaaggacgttgacgatgagtagctgctcaggtgtcatcacagcaccccagccaacgaggacggccagtagcatcgtgaaaatttgggcaaaattaaccgaaatcagaaattcaacggcttttaaaatattttgatagacggttcgaccttgtgcgacagcatcgataatcgtagcaaagttatcgtcggtcaaaaccatatcggcagcatttttggccacatctgtcccagtgatgcccatggcaatgccgacgtcggcagctttgagcgctggcgcatcattgacgccgtcaccggtcatggcgaccaccgcatcttgtttttgccaagctttgacgattcgaattttatcactcggggtagtccgcgcgaacacgcggatatcagcaatattggccgccagatcctcgtcgctcatttggctgaggtcatggccggtgattgcttgttggccgctttcaaggatgccaatgtctttagcaatggctttggccgtaccgagatgatccccagtgatcataaccgttgtaatgccggcctgtttagcagcgcgaatggcagcgggcacttcagggcgcggcggatcaatgataccaatcaatcccaacggttgtacggcggttagctgtgtttcccagttttccccaggatcggtttcaaattgttgatagccagccgccagtacccgcaatgcttgtgccgtcatttggtcatggattgcggtggcagtttgctcccagttttcaggcgcaaagttaattcggtcgactgctcctttaataatcgctagatagtggccatccggcgtgcgatgcaaagtcgccatggttttcttgtcagatgaaaacggcgcttcagccacacgcggatagatttgctcagcctcggtccgactcagatcgtaatgatcaagtagccgaacaattgccagttcagtcgcatcgccgatatctggttcatcatcagcagttaagtgtgcgttggttgcaagaccgagatacttgaaaaagcgggtgtcattggctgacaactttgtgttggcgactttatgaatttctttgccataaggccagaaatgggtaactgtcatgcgattctgcgtgagggtcccagttttgtctgaggcaatcacgttcacgttcccaatggtttcaacagcggtgacttggcgaataatcgcgtggcgcttggccatcttctgaacgccatgagccaaactgagggtgacgatgacgggcaaggtttctggaactgcagcaatggcgaggctgacaccaagcatcaagctatctgtaaagccttcctgatgaagcaaggttgccagtaaaatggtgatgataccgcccaagatagcaacgaaggatagccgcttgccaagtgtgtttaaccgtttggccaatggcgtcgtctgcttttttgtctgattgagcagtgcagcaatttttcccagttcggtgtccatgccggtagccgtcacaatcgcagttgccttgccgctggtaatggctgtgccagagaaaatataattggcagcatccccaagatcatcaggagcagtggccaaggcttctgccgttttggtcacgcccagactttcgccagttaaaattgcttcatccgcttcaagttcttggctttgaatgattctggcgtctgcaggaaccgcatcgccggccttgaggagaatcaaatcgcctggaacaagctcggcggcctgaatggtttgcgtcttgccttcacgaacaacggtgacggtttggatcgtcatggctttcaaagcagcgagtgctttttcagcgctgtgttcttggtacaaagcgatcacaacattgagaatgacgatggcgccaataacaatggttttggtccagtcactgtcagtcgtcaaggccagataggcagagagaccaacggcaaaaagcaaaattagtgaggtgatatcgctgaggtgatggccgatttgccggagcaagctaggctttttagccgcggtgagctgattacggccattttgctgcaaacgtgcagctgcttctttagcagtcaggccggttttggtgttcgtcgttaattcagcggccagatcgcttggcgttaagcgcgtcaagtgcttggtcgttgttgtcatgagttcattcctttcaatttgtcagagacacgatcattacttacttataataaccgtaacataaaaatattggtgttgtaaaatttaaaatgagtttagacatgagcaccatcggctagttcaaacatatttgtggcatttagcttattcttttgtgctcaaaaaagccgctagcctgatgtcgtcattcaaacaacaggttagcggctttcttgattttaaatagtggcgcttgtggctagttttgtaatgcgtgataaggataacttgtttgttgcgtcgtttgggttttgaagccgtatgtgtcggcaacgatatagagcggtcgatggcggctttcagcgaacatcctcgcgatgtaggtgccgagcatgccaatggtgaaggtaataccagcgccaactagcaaggtgatgatcatgacccaggttaagctagtgaggtggcctagtgccaaactaagcccaaagagcgcgaccgcgatgatcaggaagaagccgcttagccagctagctaaagttaacggtactgtggaaaaactagtgatcccatccatagctaagtgaagcatttttctcagtggatagtgcgtttcaccggcttcccgttcttgacgatcgtactcaacggcaatttgtttgtagccgacccaagtgaccatcccgcgtacatatgggtcctgttcattcatctgcttgagaacattgacaacacgccgatccatcaaacggaagtcgccggtatcgacaggaatgttgatgctagtgacagccttgagtaagcgataaaacatttcggcagtcaacttcttaaaccacgtttcaccactgcgtttgcgccgcttaccgtaaacgacgtcatagccttcacgccagcgggctaacatttctgggataacacgcggcgggtcttgcagatcggcgtccatgaccaccactgcatcgccgctggcatagcgaatgccggcagtgattgctagctgatggccgaagttgcgggagaaatcgactaaccgaatcgccggatttttggccatggcggccctgatttgatcagcactgtcgtctgttgagccgtcattgacgaaaattaactcgtatcgttccggccgtgcacgaacgtaatttgccaaaaccgttaaagtttcgccgatgccagcactttcgttataaaccggcaacacaatcgaaatgaatggattcttttcttgtcgcatatcggggactcctttcatagagagatcaagacgctttatttcaccatgctggcatcgagttcatacaaggtgccgccgcccatgccgcctcggctgccaaagccttgcgtgctggacgatgaagtgccgccatattgacttgcggcaacctttttgccgactttggtgacccaagcttcaatcttcgaattgcctgagcggccagaggaaaggtaatacttcatatcgccctttttaacaagcgctttgaactgtttcagggtgatagctggatcagtcccgttaaagccgccaatggccatgaccgctttgccagatttgatgatatacggggctgcagtgctggcgttgctggttgcaaacaggtatttggaattgccttgatgtttttcaacatactttagcaagccagaatctgctgtgccgttgccgagtccaccgttaccgctagaggagagcagtgatggaccggcagaaggaataccagccgaggaaccagctattgttggcgttaaggaccagaatgctggtgcggccatgattgctgcgatggcaacgcctaacgctgttttacgccatgctttagtgcggccgatgaacagaagtatcaaaccgagcaggccgccagcgatgactaagaatggctgccattgataatagagactgacataccaagcctgcaagcctgtggtgaccacgattgcgattggcaaaagccatgcttgccaatgtttcagatcggttttgaattgtttgaacatagtgacagttccgatgccgaataaggcggcaattggtggtgccaacatgatcatgtaataaggatggaagaagctggcgatggagaagaagccagcaacggggatgagccatccaagccaaaagagcaagtgattttgttgaatggttgtctggtaccatttccgtttgcggtccaaatagtaggtaaaggcactgatgaagccaatgattgcagctggcagaagccaactgatttgtggacctaaatcagattgcaataggcgtaatggaccgactgtcccgatggagaaagcaccaccagcaccgccacgttgactgccttgacgaccacgtgtaccgcccttaaacgtcccttttttgaagttggcaggcattttgcgacctgtaccagcgcctctttcggtcgtcacagcgggttgcttcccagccgcgccagtcttagtgccgggcatttttgttccggcaggtggtgttttgcctgtgttgccggcaccaggcgttccagttggtttcctagcagtcgtgccacccggcgccgtgcctttagcaccggttggcggggtgccagcagtgccagtggagccggtcttggatttggtacccataccagggaaggcagcaccagttcctgtggtttgtccgagtaatcgttcagtgccgttgtagccaaaagccagctccaattcagagttagtttccgaactgccaacgtaaggccgttgactagtggcggttgaatccacctgtattggccaagcgagggtggtgatggccatagcaaccaaggcaatagccaaggtgcctaggcgccgccaaagtttctgattggaagccagccagaagaataagagcaaagccggcagaatcataaacgcctgtagcatcttgatgttaaaagagacgccgatcagcgcgaaactcacaacaacgagccatggcttgcgattgctaatggccttcatgaggcaccaactggcgagtaagaggaagaactgaagggttgcatccatattattcgttcgtgaatcagcaacaacgatcggtgtcagcgttaacgccaacgcagcaagccgtgctgcccaaatgttaaagcgcggtttgatcatgttgtagatcaaggcgacgctgccaatcccgaaaagaatggatggcaaaacaacggaccaaccatgtacgccaaaaatttttgccgaaatagccatgaaccacaaggcaactggcggtttatcaacggtgatgaagccggcgggatcgaaggcaccataccagaagttatgccagctttgaatcatactggtaatagcggcggtgtagtagtcgttagcgttaccggcttcccaaatattccaagcatatagaaaggcggctaggatcagaatgccaataaaccaccaatcaacggtccactgtttaatttttttcatgtgcagcaactcccttttctcgaaatacccagaacttgcttaaaaggaagttcgttgggacagtgatcatcaatgcgaacataggtgcaagcggcttgggtagtcgtaagaaatcattccaaaaacttgtcaaaactaaacttagaatgaaggtcaggccataggagagataataacgcggtgccaccgttttgagttggcgtcgatcttttgccttgaacacccatgtgtcattaagaaataggccaaaaatggatgtcagcccgtagccaacccccatggcggctgtcgggttgatcagctgatataatgtcaagtaaatgagataagttaaaatggtattgaccccaccgaccaagccgaagccgatgaattgtttcagcttttgacgcatcaaaccgctcccttcttggtgaatgggatcattatgagagttacagcataaattaaccttaaagtcgggcattctatttcttaagatgactttatggttatcatgatatggtcagaccagcagatataaggttaccaacaaataagtggggcagaacatgacagttaaaccgagaattcttgtgatcgaagacgatccggatttaaacgagagtattactgattttatccgcgcatttgccgacccagaagccgccttaaacggtgctgatggtctgtatttggccgaggaaggtatttttgatgccattattttggacattatgttgccagaattaaatggttttgacgtactcaagaagttgcgggcaaagcaaattaaaacgcctgtattgattttgacagccaaagatgcgctgaccgataaattgcacgggtttgaacttggcggagatgattatctgacgaagccgtttcatcgtgaagaactcattatgcgtttgaaggcgttgttaaagcgaaccggtcacttctttgacgatgatggcttaactgctggtccttttgtggtacatgtgacgagtcatgaggtgctcatcaacgatcaaccagtggccttgaacggtaaagaattcgatctgttggtttatctattacaaaatcagaaaacaattatcaccaaagatcagatttttgatcgtttgtggggatttgattctgaaacagctgtcagcgtggtggaggtttacatgtccaacctgcgcaaaaaattaaaaccgctaaaagttgagcattggatcaaaacgattcgcaacgttggctatatttttcaggagccggagggcagtgaatgaacgcagaaaaaggtattaaacatcagcaacgtcgcttattcatcgggcaactgttgagctttgcgggcttgtttgtggtattaggtatcattgtttttttcttatatgagcgctcaatttatcaagacattgatcacaccttagagcagcaacaagcaatgattcttaatccaaacgaagaaacgacaaagcttggtccgcagcaacccggtacgagagtaactcacccagcacctttcaggaccaacatggtggtctttaaccaaaaagggcgcatcattaatcaagccatgcttggtgagcggttttatgcttactttaaaaatttaaaactggatcgatcagcgcaaaacaagttacagacattgaccacatcaactggaacattccggacgctattaatcaaagcacctaaatacagcgcagatcctcagtatgccggtcactatgtgttaattttgcaaaataccgatgcacaggaagcagcgattcgatcatttcggcaggttctgattgtcaccattattcttttttgggcattggcactcggcttgtcatactggttgtccacacgtgctatgcggccaattgtccggtcatggcagcgacaacaggatttcgttgccgacgcagcacacgagttgcgggcgccacttgccgtgattcaaagcaagcaggaagccctgctgacgaaaccacaagcgaccatcattgacgaaagtgaggcaattgcgacttcgttgggtgagacgaaacgcttgcgtcagctgaccgatgatctgctaacaattgccaaagccgatagcaacaccatcgaaattgaattggttgatcaaccttttgaaaaggcctttgaaccacagctgtcttcttatcaagatattgctgtcagtcagcagaagtcccttacaacaacgctacccaaggccggtcatgcactgtttgacacggcgaggatgaaacaactgttagtgattttactggacaatgcctttaaatatacacaggcgggtgattctatctgggttgaagtgacacagacaccacgtgattggcagttgcaggttggcaattctgggccgagtattgcggatgctgataaagctcgcgtttttgaacgtttttatcgagaagatgcctcgcgtagtcgccaaacaggtggtagtggacttggtttagcaattgctcggtggattgtgaccatgcatcacgggcatattgaagtcaaggatgtccatcctcatggcgcacttttcatcgcgaccttcccaaataagccgcgtatgcgttgatcaaaccaaagaacatagaaaaagccgcgtcaaaaatcaattgtgatttttgacgcggcttttctgttacgagttgttaagaatgcaccgagattacgtttcttgaaaatagcagttagcgagcagggttatttcgaacaccattggcttcggtgaagtcaataaagcccatattggtatcaatatcaccgccgtcaccactcaaaaccaaggtattcagcgttttgttaaagtggacattcatgtgggcattcaaatcttcttgcgaataacccttgatcagaattggcccaaggttactgtcaatttcagtgtcataatccgttgccggatcgctagcttttacgacgttaagtgagaactggacctgcatatggatcatcgcatgctgcgaataaggacccaccccatcttcaaacgtaagcagcaactttttgtcatcgcccagatgcggttggattttttcagtggcaccttcatcaaaatgaatttgcataggatcagctcctttcgccgttaacataggctgatttggcgttaaaagcaactgatttgtctcgcagggaaaatgacgttaaagccatcaaattatcgagtaaaagtgagtttattgtgattcaaatatcgacgcaccttaaaacttgcgccaagtttgaaacaagtttcagcatcttttaaatcaattccagtaatgtcactgatgtgcttgagccggtagcgcaacgtgtttaagtgaatgaaaagttgcctagcagtgtgggtgaggttttcaccagattcaagataagcgtccagtgtcggcaacaactcagttttattctcagcatcatgatccatcaatgccttaaccgccggattgatgaaaaatggcaaaatttcggcatgatcgacctgtgccagcattaagtcaaaaaaggcatcctcacacatggtgacgtgagttggttgagatttaagcttcgcagtgcgactgcagacggcataggcagcgatggtatcttcaggccgcgtatattgattcgaaacgatcaaacgacagttggcacgatcggcaatggtcgctaaatcagctttaaattcagggttgttgtaagttggcaagtcgacagaaactaaggctagacattgatgatgataaagtgtgatcaaagtttgtgagaaaagcggggttaataaatactttagtcgctctttcaacgctgccaaagattgtccagcacgcggctcacctttaatcaaaaccatgcttgttggcaatgttgcatgttctttcgcaaactgagcggcaaaggtaccactttgttgttcggtaagcagcatggtgagcagttgatcgcgttttgaggcggcggtcggcatcatccggtttttgatcaaggagctggtgataattttggcttcggctttgaagaaggcagtttgttcagcggtgagcggtctgacgcaggctggcatgacgaggtagcctagggcattgttgcgataggccaatggcagacataaaagcagcaagggcagctgtgattgctgaatgagaataacttgcgggatcaagtctttagcgggtctgaattttttcaatgcctgttggacctggacagaggtaatagctggcgctgtcaagtcactaatggccggcgcttgcgtggattgcgccacaggttgcccgacaagatcaagaacaatcaagggattacctaatgtccgggcggcttgattaagaatcgtgtcgaagtcctctgtgatcgctttaatagcaagctgattaatctgtgcttgtaaacttgtttcggacgtcaaaagacaaccagcccgatcgaatagttgagcaagttgcgactcgttttttagctgcgtttgagcacacagggacagttgtgcagtcttgccaacagctcctttcaaggtaatcgtttgatcagcagatacagcaagatacagtgaggtcggatgtggcgaaagagtcatatcatcgtcaaattgcagacttgttatttcggggttttggagactggtatcaaaggttaatgggactgtttggtcaagtcgttggagcaaagtatttaatttcattatttatcctcgaaggtgacgtgaaggtggcacgtgtcaattagcaaaaacatacaaatttatttgttcattcatgtgcaaactgtaccttcatcatacgttttgaaagcgctatcgtaaaggcgtattcgaaattgtgaataagcacacacatgaatgactgcgtgcgtggattcacgccacataggaggcaagcaattatgaaggattttaaggacaaggtcatgttcatcaccggggccgcccacggatttggtcgggtcattgctgaagaaggggcaaaacgggggatgaagctcgccttagtcgatatcgacaagccggctttgaatgaaacttatcaaatcgttgtggcaacaggggcggatgctgtgatgattccgactgatgttaccaaagaagacgaagttaacgcagctattgatcagacacttcaagcatttaagcaaatcgatttgctgatcaatgatgcagggattgctttgccaggacgtatgtgggaattaccaacccgtgattgggaatggatcatgcacgtcaatgtgatgagtcaggtttatgcgatgaagcggattattccaattatgatggcgcaaaaaacgcacggggcgattttaaacgtcgcttcgatcgctggcttggtcgataccccaggcatgcctgcatatcacgccagcaagtttgctagcgtcggtatgagtgaagcaactgcttatgatctgcagcgggccggtgctgatattgaaatgcatgtgatgtgcccaggttttgttcagacggatctttatcacactgaagaacatcggccaaagcaatacagcaatccaagtgatccttactatcaaagcgaggctttcctgaaaggtcaacagtttgccaaatatgtgatcaccaacggtatgccacttgatacgattgcggcgacggttttcaaagcacttgaagaagatcagttttacattttgacccacccacagttcaacccattgattttggatcgggtcaatcggatcgtcaaaaatggtgcaccagatgttcatgtgatggatgggattatgtagttagttactttcgataacacgcgaatcagtgcctcaaccgcgctggcgagcgttcacagagaaggagtgtcaaaaatgtcgagctatgttgtgagtcaagaagacgtgaagaactttctgaatttaccaagtatgaatgatcaagaagggatcagttttgcctatgccacggatccagacgtcttggccaaattgattccggcaccgttgaagttggttgcaccagttgtctgcggctacgtcgtccacatgggcaagccgtcgtttggcggaccttatctggaacaaacgttatttgcccttgttagctacaaagacaaaatgatgggttcctatccactaaccttgctcctgcatggccctggtgctgaagccggcttggtggcaggtcgtgaaggtgcaggtattcctaagaagctcgccgatcacatcgaactgcggcgcaatgacaacagtgccagtgccacggtggaacgtcacggcaagacgctgctttcggttgattgggaagccggggatgtcaatgatccttccattttgcaaacatttggcagtcaatttgccttaaacaaagaatccgaaatgaacagtttcttcttcacccatgatcttgtacaggataaacaaggtgcgaaccactttgaaaatgttgagctggtcgccacacagatgaagtcgttagctgatcgagttgagctagggaaactgtcgattcaacttgcatcaactgaagatgatccattcggtgaattgccagtgctcaagccgcttggtgcgatgtggtatcattttgcgacttcgaccatgttcaacactttgcatctggaacaagtcgatgccgataaaaccgccccttatttgatcaccggccgctacgatcgcagcatgatgaatccgctggcaacgacctatattatttgattgaaaacggttaatattgatattaagaaatgaggcaaataaaaatgacagaaacagtagcaacaaaaaaattaactaataatgacttcgcagacgtgatgtttgatcgccactcagttcgggtgttcgatccatcagttaaaatcagtcgcgacgagcttcaggaaatgattaaagaagctaccaccgcgccatctgcctgcaacttgcagtcgtggcactttgtcattattgatacaccagaaggcaaagaaaaattgaaaaagtctgccatgaaattcaactatccgcagatcgattccagttctgccatcatcttcatcgccggcgatacgcagtctcatgaagtttatcgtgatgtttggaccaaggtttatgaagacggcaaaatcagcaaggaaaagttggaccagattttcaataccttcctgccattatatgaaaatgcttcacctgaatttctgacattagatgccaccatcgatggcgccatggttggtatgcaactgctgctgacggcgcgggcacatggctttgatgccaatccgtggtccggttacgacttcaagacgattattccaacattgggacttgatccaaaacgctttgtgccagttatggcagtggctattggtaaagcagctgagaagccgattcatactgatcgctatgatgtgaagcagctgattgactatttggactaatatgacggcacaaactgcccgagatgagtgggcacgtttaattttttagaaatagagaggaagtttacgatggtcgatgcagtagagaccgatccattcggcaaagttgatgcgattgatgtgttggatttagccagtttggaggcgcgtgcggagaaaattcttggccgtggtgaatttggctatatcagcgaaggctctgacgatggttacaccatgcgccgcaacaccaccgcttttacagatgtacaaatgctcccacgcgtgctccaaggagtggagaatccggatcaaagtacgacttttatgggagcaaaactggcgtcaccgctgttaactgcgccgatcgccgggaacacgctggcacatccaagtggtgaattgggcttagcaaaaggcgcaaaagaagccggtattatgatgtcgcaaagcacctttgcctccaagacaattgcggaaactgctgcggtcagcgacggtgccccttatatgttccaactttacatgccaaaagattggtcgtattgccaatatttgttagatcaggcaaaacaagcaggcgcattggcgatcattctgacggccgattcgacacttggcggctatcgggaaaaagacgtgatgaatcattatcatctcaaaggccgcttagctaatcttgaaggttacaatactgggcagcagggagttggcgctggcggtttgtttaaagaatccatgcagaaactggatcttgcaaccatcgataagttggcctcttattcagggctgccaattattgtcaaaggcattcagcatcctgatgatgcggttgcggcgattacagctggtgcagccggcatctatgtttccaaccacggtggccgccaactagatggtgcgccaggtgcgattgaagccttaccagcaattgcggctgcagttgatcatcgcgtaccaattatctttgacggtggcgtccaacgcggcacccatgtcctgaaggccttggccctcggcgccgatcttgtcggcatcggccggccattcagttatggcttagccctcggcggctgggaaggcgtcaaggcggtagccgatcacatgaagatggaaatcaacatcgccatgcagctaaccggttgtcaaacgatggccgacgtcaagcagatgcagattaaaaccacttttgcataatcagagaaaatgtccacctgataagggttgggcatttttttgtttcagggaaaagatgatgattgttttggcaaatgctaacaacaaaaaatgccagcgacagtagacgaaattgtctaactgtcgctggcgtttttcgaaatcaacactgcctgcccagcaagaaatgttgactattccttttagcttatgagcgcaagtttgatgttcagtgaagctaattgccagaagaaaatcacccatggatcttaacggacttgaaccgtcgacctcctgcatgccatgcaggcgctctcccaactgagctaaagacccgccatgaaagctgatataaaatggatccaaacggacttgaaccgtcgacctcctacatgcgaagcaggcgctctcccaactgagctatggacccaaaacacaagattcattgtactgaacttccggtctgctgtaaagaggcatgcttgtgaatatcagagaagaaaagctgccgtgacggacttgcacaatgaatcgaaacgcttattttgaataatctcgacgcgagattaaggcggtgaagatgttttcaaagaaaccgccaatgataaagataagccaagaataagcccaaccgcccagaacgaagctagcaaggagatagatgacaaagatagccggccaatagacttggtggaaaagtgctatatcttggcgtgctcgtgaattctgatgatgtttgtgcggttggctccaatgggtagcgtcatcagcagtgacattgtaccaagcagttgagtttgccgcagttgtcgcgtaagcataacgttttagctgagaataattgatggagacataaatgatcaggtagctgcctaggccagcaattgctagaaatagcgctccgccagcattttcactgataaaaccaggaatgtaggcagaaatgatgggtgggatgagagagccgatgcagatcataataccagcaatcaacccggcggcaaattgacgggtgtattccccgatggtcttgttggctagctgtttggcactggctgtgatcggccggtcattaagctgctttttttgctggctgaagacggtgccgccccagatgaacagaccaactgcaagtgcagcaagcagaaacatgccaatcacaccgaatccttcccagcggcccccgcctgtgtaggcaggcaaggcgatactgacggcgcaaagcaaaacaccaagggcaatttgggtggcaaactgatcggccatgtgccaaaagctgcgaagttcggtttcagtaatcgcatcttcatcggcttcttcctcagcatcggtggggtccgactgtgttgttgtcgccgatgcttgtgctggcattcccagatcagcccgtagctcgtcaattgagccaaacgcgctgatgacagcaccaatagcggcttcttcgcttttaccttcgcgcaacaaatcacggtaataatcacgcatgttagcgagcatatcggctttggcttgtcgggttttgtcattatcaggtaaggaagcaaaaagactatctaggtaggtggtgatggtatccatgggcgattcctccaaggttaaagattcgttagcggctgttttaagaatggatcgacaacggttttgacacgttcccattcggctgctttaacagcaagaaaattacggccgcttggggtaatgcgataataagtgcggggcttgccattggtgacatcccctgggtaatcattgatgtagccatttttgctaagtcggttgaagacggcgtaaagggttgtttctcgaatgaggtattgaccatctgtgcgctcacgaatttctttgccaattttatagccgtaggaatcgccttgctgtaaaatcgcaagaatgagcgcatcattatacccacgcatggcgtcactgctaatcacagcatgacctccctctatcgttatggactgatgcaaagcacgtttcagagtgctttacatcagtactgcatctgttgaagtaatactagcacgattactctatcaggtaaagtaaaaaacaccctcatctaagatgaaggtgttgtcgaatagcggcttattagtggatgaaaactgtgatgaaagtcaccagcccgaacagaataccgggcatatttgagatgataatcggccagtctttgtatgttttagtccaaccatagaaggtccacaaagtggcattgatcatcgcaaccagtggttgaatcggattaaccggattcccggagaagttggcgatgatttcgggaatataagaaacatacattaaaatacaggtgaatgtcgcgactttactcaataacttgagtcgtttcactcgaacggggtcaaccccttcaggatactttccggtgtcaacgcgcattcataacgcctcctttttggataaaaataaccataacactaaattagtctaaacccaaggcatgtgtctgggtgtgatagaatcaagaaggcgacagaccgcggataagcggctctaaaaattttctgaaaacaagcagattaaggaggattacgatggcagaacaatcggagaacaccgtgacgcgaacacaaaagcaagaaggtgcggatgcgattatggataagggttacgtcactgagcgggatattccggaaatgatgagcaaaacatggagcgaacaacttcttgatgctgttaatgatgagttgcgcttgcgcacggtgaccaatcgtaccgtgttacagcaatttcactattacatgggtaacggcacgatcatttatgatccgggtcagctgaactctggaggtgccaagatcgccttacagcacgccttaggtttccgcaaataaagctaaactgcttgtaatggttatcggcagtttagcttttttgatggtcgtgagtggtgttaagcaaacgggccagtcaaaacaaccttgcccacttcatggccaccttcaactagagcggtcgcagtcttaagggtgtcaaccgagatggtgtcaaaatgcttggtcactgatgccttgatttgatggtcctgatagagtgagactagacggctcagaatagcaccttgagaagccacgtgataatcaaagtcggttttggcaaacatgtactcataatcaaaactggcagctttatctttaacaacggccaaatccaaaccagtttgtgggccaacaatacagcctatgtggccaaaggcacgaatcagctgactggctgctgccaagtaaggttctggttgataaagcaacgcgacaccgtcgactgtttgcaagccggcacgttggacttgggcaatcaaatcctgatggtaatccagtggtgttgcaacgccgtgatcaagcagccaaggatgattttttggactgctagttgctaggacggttaaaccgctccaacgagctaattgacaaagcatggagccaacgccgccagcaccgttgatgactaacaagtgttgtcctttattagcgttgaattcggggataaagcccattttttcgaagagtaattcccatgcggttaaaccgacaagtggcagcgcagcaagatcggcatctggggcatcagctggcgcggcagcgagtaagcgggcatcaactgcctgatattgctgattactgccgggacggtgtgttgtaccagcatagatgacgcgatcaccaggcttgaagctggtgacattggcaccgatctgtgtaatcgtcccgactgcatcatagccttgaatttgcggtgtttgatgctttccagcaacttgtcggcgtttcgtatcaacaggattgacggagactccggcaacagccacgatcacttcgcctgactggggctgcggcattggcagcgtgaactgttgaagacccttgggtgccgtgattggcaacccttctgtaaagccaattgcaagattttgtgtcatcgaaatcgccctttctgtaaataaagacctactgtgattgtaacctttttccacgaatagttggaagttccggttttttttggtaaaatgtgcaagatattgcaaggaacagtatggtgttggcacagttggcggttgatgaatctgcaggttatgaaccattgattgtcatactaccggtcaccatgatgaagacagcatgtgacgcggcagcgtttctaagtcgaagatcacattaaaggaggctgcaaagtgaaaaaacttggtactaagcgcgaattgatcggtgttgtcattgtcttgctgttggcagcagtaggatttgcgctctttgcctggtatacgatgcggccaacagataccattggcacgattgccacgctttcttttggacttgttttgtcagcattgattggcattgtcctgattttagacacggcagcgaccacgcgctggcgccgattctgggtcgatctactttttgcggcattgatgttgaccctgattgattatttcttcttagataccacggcaccatggcagatgttggtggcaggagcaggggtcgctctggcgattgtcgcattgctggccattagaaaaatcgatgagtaagttgctaaaagagtccgatgaatcgggtataagcctagtgaaagtaaatgaaaactccctgaaaattttcagggagttttttgtcgatatttgctgatggtaacaacttgtggcaaacgctatttgttattgcgccgctagttcatgcgttggacagtcacaggcactgtttttggcaaaactttcgtgagttccgtcataaagttttgaagacttgcttggaaagtcaggcgaaccatgcgccgtttgctaagagcaaaaacggcaacaacccattcctgaccattaggcaaactaaccggcgtcaacgtgatgctggacatgttcgcgtaaggaataacacgcgccagaataccattcgcgattaagcgcgttggcgccaatccaccggtaccggccatgatcgacaaaaccaaaaagattgagatgaagacaatgtaaggcaaattgtcgacccgagtggtcataaaccaaaagcctaggaaaactgcccacatcagctgggtgacagcgtaacgagaagcaacttgaattttactttgccaataaagatagtaaccggcaagcgccatcaggatgacgtcaaggccgatcagaaaaacattaaaattattcatgaggaactcctttttgcttcatgtcatctgtggcatgctcggcttcatagagcccggaaacctgttgataccaactaaagaagcgggtgaccacgatcttcaacacggcgaatcctggaatgccaagaataacgccgactaagccgaatagattacctgcagttaacaacacgacgacaatggtgatgggatgtaattcaagtttactccccatcacaagcggtgagatgacttgtgtttcgatgagccattcaatgaaaaagacgatgatgacagctaaaatcattcgcggggaggttagggcacccatgatgagcggcggaatcatcgccaaggctgagccaaagtatgggatcaaattcagggggcatgccaataagccgaagataaggccataacgtaaaccgatcactgaatagccgaccatgaacatcacggcaacgcataaggcaacggtgatttgaccttggacataagaaccgaccttttcattcatctcatgcaacatttgcttgactgaccggcgaagtttagttggcacgatatgaagtaccatcggcgtaaatttgtcgccgtcttttaacatgaagaaaagaatgattggcgctgttgaaatggtgatgacgacattaccaacaatgccaattaagttctgcagttgagaaattgtgccggttacgaaggcaccttgtttaccagtgaagaaactttgcacttctgctgcaatctcattgagatcatgctgtgagagaatattctgctggtcattcagattatccaaccatttgccaatttcatcaaagatttgcggcgctgaatggacaatactggtaatttgattgcttactgctggaatgaagcgcaacaatccccaggccaacaaaccgatcagcacaatgaatagcaggccaattgcccagccacgatgaagtccgaacttttctaatcgattaataatcgggacagtaaggtagaagagaatgccggcaaagataaacggtggcgcgataatcccgagaaaatccagtactggctggaaaacccacgcaattttagtgaaaacgaaaatcacgagcaatgccagtaacaagtcaactaacaggatcataaacttgctattaagaaagcggcgatagagccacgagtcggtatgtttcaagggggtaccctcctctacaattgtaatacctgttggatgtataagcttcatgacaataacaaacgatgagagcgactagccagatttgcgggggccctgttcacgctcattaaaacgcgttcacaggcacagaaacctgcacataaggacctccaacctaaatgacccaagcccggccatttaggttggaggccacttatgcttcggtttctaaatgtgcctgttcacgctctgtaccattaatgatactcgactcatggtcatatttcgaggatagccgtgttaaaagcggattgatttgatgttaaaaaagattacataaaatttacaaacaacatggaataatcgttacaaatctttaaaaaccctaaataaaggcatcaaatgtaaattttatgtatacaaaggctttacaaaactcaaaaattgggtatgattagagtcacaaccaaaacggtgagtatatgtcggtttatccgatacggagaggagtgaccccacatgacaatcctacggggcgcaaaatggacattaattactctgaccctcgtggcaaccttgctgttattcagcaactttgcgacagccggcattttgttaatcgcgcttgatattttcttgagtttcttctacgcggtcatcaaaagcagatgtgatcggcgtcagatgcataagatgccattattgcataattaatttaaggatgaggtccacagatgctttttatctgtggacttttttgctatttaggcataaaatcattgcaaacgttcgttcgctttggtatgctttgtgtaatcaattagaactgaggcggtgagcggatgccaacacaagcaagtcagaaacgttggaaacaaattttacaatcaatctatgatgcaatcgaggatcatgggtacccgcccacggttcgcgaaatcggcaaatcagtcggtctaagttcgtcaagcacggtggcagcgtacttggagaaattgttagcggcgggacttattgctaaggatccagcgaagccgcggacgcttgaagtgacctcagccggacgtgacttcattggcgttcaggatcacggtattccgatcgtcggcacagttgctgcaggggtcccgattacggccatcgaaaatatcgatgattattttccggtaccagacgatcttccgtatgccgctgacgaattattcatgttgcgagttcaaggtaattcaatgatcaaaatcggcattttagatggtgaccagattattgtcaagaagcagaatgacgcagagaatgggcaaattgttgttgcaatgactgaggaagatgaagccactgtcaagcgattttataaagaaaagaacggcattcggttacatcctgaaaatgacagtatggatgatatgtttttcccggatgtaacgattcttggcatcgttgtgagtttatatcggccggcattagtttaaccatttgaagtcgtgaatgactaggcatggcaacttaaatccaattaaaaatgtaccatcaacaaaagagacattagctgtgatcccacaaaatataggatcacggctgatgtctttttgctcagacactttattggttttgttgggcgaggcgatcgagatcgtcttgtggcacccttttataaacgggaccatcgggcaactgctttaagttaccggtttttgttaattgaaattgtatcgtattagcagaggcttgcggctgcgctttaccagtgaaggtgaagattcggcctttgagggtcaaatcagcagcaaaaataccactatcagtactttcaaagacaccatctcgattggctaatgtttcaagatagtagccgctggtggatgaggtgactcgaattgctttggtagcatcttttgtttggacgaacgcatggccaaccaatgtacctaaggttgctttcggaacagtttttttgaccgtgcgcgcttgtgatgttgcgctcgatgatgatgttgtctttttgggggttgaggtagtttgtgagcaacctgataagatcaagattgctgctagtagcagatagcgctttttcattcgacagcaactcctagtgaatgaactggatgcaagtcatcacgattgggatcacgatcatcgaaagcagcgttgtttcggtgaccatgatagcagcgtaatcggaatccgcatcgtacagtttggcaacaacaggcgcattggtcatgaccggcatgcaagattgcaaaataaagatttgtttcatcaaagttgggacaggggcgaaggcgacaagcgccgtcataagtaacggtgcaaagaggaagcggccactgaaaatacccaaagcttctttgctgattcttaatttaccccagcctgcttgatgcaaagcaatgccaatgaagaacatggagccgggaacagttaaggcaccgatataagtcagatcggccatcaagaaagtcggcaatttgatttttaaaagcacaagcacaatccctaacataaaaccgagtaacggcggtgagaacactttcccaagtgcctttttcaaatcaaatttagctgggcgcgggccgtcaccttgaataaggtaaacgccgatggtccaaaaaatggtggtgttggccatgtagtagaccaacacatatggcagactacttggcccaaataaggctaagttgacaggcaagccgataaaaactgtgttggagttaaaaaacattgacttaaaggtacccttacgtgcatgtggcaccttcaataagtagcaaaccagaaatgataaggcaaataggatcatcatggaaaggactgggaaaaacaaatctggcaagagtcgcagcaacattggcgccgtgaattttgaagcaatcgtgacaatcatgtaggctggtaaagcaacttgggtgacaactttggcaatgattttacttgaatggtcattaaaccacccgcgtgctgtcagaaaatagccgagtgcgattagaatcaaaatttcaagaacaccaaaaacactggaaataaatgcggtcaaatactgacactcctttataaaattattttggccgccgcagtgtaaaggtgcgtccaagctcggcgtatgtcggcccggcgaggcgggcaatcggcgccaaagcggtgggatcaatgtgaagcgttgtcggatcaagaaccgtatcggcaaaatggaatcgttgcacttctaaaatgaaaagatcagtcaaaatggcaccatcagcgttacgaatcggcacgtattgataaagcttggtttcaaatcgaacacgcgctgcctgcaaccccggcacctgaatgtccgtacttgcaactaacggcaggtcaatcaacgacaactcgctttgatcaggtgctaagcgggcagctgtttgattcatggccttcgtgagatctgcactcacgatgtgaacaacggcctcgtggcgcgccaatagatttgcagcggtatcttttgcctgaccccgatcacgtaaaactgctactgacaacagtggcagttggtttgaaatcccggtcgtaaatgaaaaaggcgctaggttaatgaggccagtcgtgttttgcgtggtaatccaagcgattggccgcgggatgatactgccagccagcaatttatattgatcacgcgcggataagtcggcggcagcaaggttgaacatcgtggtcctccagaaagttggtaacgcggcaggtgcgttaaattgagtgggtcgcatttgggtgtggtcatcaacttgattttgcccactatggttgcaagtttagcgcaggcggttggcggcgtcaaagtggaaccatcatttggcatcattggtgtcagtcatggcatgttttttaaagtcatcacaaggatgtcattgatcatataaaaactgacacctgaaaaatcgggtgtcagtaagattttttaaggaaattaattaactgggactactgcttgaaactgccgagctgctgtctggtgacggggatggttgttcactaggcggctgcgaattgccgttatcttggtgaccattttgaccgttattgttattgccattgttattgctaccgctattatcaaccgtgctctgttgactttccacactcggctgaacagaaggcgctggcgccgctgatgatggtggctcgcttggttggctaacgatgaccggtgcgctgctgacagtgcttgactgtgcgctggctgtttcttgcgtggttttgaatttagccagactggttagctttttcttcgatttgcttagtggcaaattggtctcaacatagcgataactgtgcggtgttttgtttttcagcgtaatcgtgttgttcaactcggatgtgagcgtcttggtgtagcttcgaacagtgccggtcgcgccatcaactgaatactggcgaacggcagtcggcttattgttcttgtacgtcgtcgcactggcatattcataaacattagcgtgttcggatgtcaatgttagcttgccattttttcgcttaaaactgccggtgtcgttgacgacaaatggatgcccatgaggatcgagaatgagcaggcgagtgtaggtttggtcatctgtcagcttaacatagacggttaagtcatgttgatcgcggtctagatcgatgaccgtgcccgaagccttataagtaccgctgttaaatgggtgcgtgacggcgaccgaagatgaaacactgctgctggaagatgtcaccgggccttgaactttagcaccgcgaagaacgagccacataaaaacagctacaaaaataaccgcggcaccaataccggtgagcgtgagataaagcgttcgacgattcttgcgaatacgttcacgtcgcatattgtgcctcctgaaataagatgaaaaaggtttattttaatataaggaatgtccagtagaaaggcaatcttttaccaaatgcttaacctaaccgttacacaatgacatccccattagcaagaatcaaggtttgaattggaacatcaaacggctccacaggccaagccacttgcggaaacgccatcacgggtggtaccagtgtgatcgtggtgccgcgataagttgtcaggaagcgatcataatagccgccaccaaaaccgatgcggtacttgtcagccagcgaaaagccaatgccaggcaccaaaatgagatcaggggcggcatgaatctgatcggcttgataaggcggctccgggataccaaaagcactggtgatcagcttgtctttgccaggatcaggtaggaaaaccatttgccgcttgggcatgacccgtggtaagtagacagctttattggcgtcgtgggccgcctgaataattggctcggttgggacttcaaacggtccgcttacggtaacaccgatgctgtgagcacgttgccacataggtgtttgaactagtgcggccaaaagcgctgcactggcagcctgagtcgctttctgggcggctttcagacgttttaactgaagcgggcgaaattcggctttgcttggcatagtgacctcactttgttttgagtagttcgcttagaacaacggcttggttatgcgtttcgtccttggcaccatagagcataatgactggctcttgttcatgttgcttcaatgttttgatgaagtctggcaggtcaggattagctgctaactcagctaagtaccgcttcttgaattcagggtacttttcagggtcgtgaccaaaccacttccgcaactcagtggacggcgcaatggttttggcccataaatccaaagcagcgttaactttgctgatgccccgtggccaaactcggtcaacaaggacacggaatccggatgcttgcggtttttggtagatgcgttcaagtgttactttcaaaatcatcacctcactgactattctaccagccttggcaactagtggccgaaggggaggatagatacgttataataaaagagaacgtgaactggcgcgtgtagcaatccgcgtgtgagcattttggacgggattggcatcgcggacaagggtgcatacagaacggcctctgcgccagtaaacgcgctttaatacggccaagaggtgttgaaatgattacgcgttatcagatccagccacgaggaaatatgcaggtaaccacagacgatcaggccaactggattcgagtttcggcgccgttgcctcaagaactacagacgctggcgacgacatacgggctgccagcaacctatctggcggcagcaaccgatcaacatgaaaatgcacgagtggaaggcttaaatccggcagatcaggtaccagggttgattgttttgcgttacccagttgaaacgactagtgaaacggggtttgatcaatacaatacggtacctatgaccatgattctactgaatgatcgtgtgatcacgattacccacgatcccttacaagctttcgatgatttggctcaacaaaaactttctcctaagcctgaagagtttgcactggaagtcctgtggttggtgctgcatcaattcgtgattgcaatggacaagctgaatgatgaaaccaagcaaattgagcgcagcttaggtaaggcggccaaaaacacgcaactttatcagttgatggccatgcaaaaagggctggtgttctttgatgcggccttggatcattctggtacgctgcttaaagccttacgcgacggtgagcgcttttttaatacgaatgggtacttacggcggttgcatgatgttgaagttgaagtggtcgaggctcaaacgatggttcggatcaccgagaagttgctgacgcagtattcaactgccgtgagtgccattgtttcgaataatttaaatttgattatgaaggtgttaactagcatcacaattattttgacgattccaaccattgtgggtggtatatatggcatgaatgttcgcttaccgtttgccaacgcttactgggctttttggtggttaatcggcggcacagccatcttgtgcggcttggcggcatggtggttgtggcgtcaggattacttttagcattaggtactttgaaaatggatgtacaaatccccgtgacgtatcgctatcgtcacggggattttgtgtgcgtccgtcagcctgagtagaaaccggcgcaagtacgaggaacgtgatggccggccttaatccttgcgacctagatccttatgcggagctttctgggttggtgaggcacgatgttgcagacgaattagtctgttttcacgactgacatgacagcgttagtttgccgcaaggatttgattaaagtgctgcattgccggtgtcaaaacacggtctttgcggcggacaatggaaatggtgaaaaccggctgttttggatcagtgagtttgacagccgcaagatggtcatcaggattgatggcgagatttgtcaaaaaaccgataccgacattttgcgccaccatttgcttaagaagttgcacatcaccggtttgatagaccacgttggggatgaatgccgactgttgttgaaaccatgtgaaggcgcgagtgtggacgaaggcttcactgagcgtcacgaatttttgcatcgccagttccgcgaatcgaaccttgtctttttgggccaacggatctgattcaggggtaataatgacaaatggcgccgtgccgatttggctgatcgtcaaatctggctcctgtaatggtccactggcgccaagtaaggcaaaatcaagatcgccttgtttgatttggtttagtaaggcggcggatcctgcttcaactgtttgcaattgtggcattaagccggcgacaataagctgcggtgcaatttttggaaagaagtagttaccaataattggtggcaagccaaatcgaattttgttggtctgatcccacgcaatttcctgctgcgccaaggtcaactgctgaaggatcacttgggcgtgtgctgctaactgtttgccagctgacgtgacaccaatgtcgtgatgacgccgatcacgaataatgagttgcgcttgaaaactgtcttcgaggcgcttgatggcggtcgtaatcgttggttgactgacggcaaactgctctgctgtttgtgaaaagttgcgggtctgcgttagcgccagaaaatattcaaaatcgcgtgtgttcaaagtgttacctccatgaaacggttgatggggaatagaagaccaattctttgattaaagcatataaaaatattttatcactcctgctgggtttgactataagatttgtcggcgtgtaatgtgacctgctgtaaagacgaaagcccgagcaatggctggttgctaaccgcgctggctggtgctcaactataacgcgctcgcagtcgcagaagcttgcgcataaggaccttgagtcaaaatggccaagatcgagccatttgggttcaagcccactcatgttccggtttctaagcgcttctgctcgcgctcaactataacgcgctcgcagtcgcagaagcttgtgcatatggaccttgagtcaaaatggccaagatcgagccattttgactcaagcccacttatgctccagcttctaagcgcttctgctcgcgctcacttagaaggagtgttgattttgaaatatacaccagagcaaattattaacgatccgtttttaaataaggggaccgcttttactcaagcagaacggaatcagtatggcttgaatggtttgttgccaccagctgtccagaccttggaccaacaagtcaagcaagcttatgctcagttaacgaccaagccgactgatctggctaagcgtcagttcttgatgacgctttttaatgagaaccatgtgctgttctataagcttttttccgagcatatcaatgaattcatgccgatcgtgtatgatccaacgattgccgatacgatcgaaaattacagtgcgctgtttgtcaatccgcaaaacgccacttatctgtcgattgacgatcctgatcatatcgaaagcgcgctgaagcacagtgccaatggccgtgatattcgcttgttagtcgttagtgatgctgaaggcatcttgggaatcggcgactggggcacccaaggcgtagatatttctgtcggcaagcttatggtttataccgctgctgctggcattgatccgagtcaagttctcccggttgtgctggatgttggcaccaataatgaagcactattgaatgatgatctttacttgggtaatcggcataagcgggtatatggcccgaagtatcgtagctttgttgatcaatttgtcaccacggcagagaagttattccctaatttgtatctgcattttgaagactttggtcgcagtaatgctgccgatattttaaatgaatacaaagaccagatcaccacgtttaacgacgatattcaaggaacagggatcattgtgttggctggtttgcttggtgcgatgaatatttctaaacagaagctgaccgatcaagtttatctgagctttggtgccggaacagccggtgccggcattacgtcgcgggtatatgaagcctttatcgaagaaggcttaagtcctgaagaagccaaaaagcatttttacttggttgataaacaaggcttactttttgatgacatgtctgacttgacaccagaacagaagccatttgctcgcaaacgcagcgaatttgcaaatgccgatgcgttgacgaatcttgaagccgttgtcaaggctgtccatccaactgtcctagttgggacatcaaccgtgcctggaacctttaccgaaagcattgttaaggaaatggctgcgcatacggaacgtccgattattttcccgttgtccaatccgaccaagcttgcggaagccaaggctgacgatttgatcaagtggacagatggccgtggtctgatcgcaactggtgtaccagcggctaatgttgactatcaaggtgtcagctatgcgattggtcaagcaaataatgctttggtttatccgggccttggcttaggcaccattgcttcaacagccaaattgttgacagattccatgatctcagcagcagcgcacagcttaggcggtattgttgaccctgatcaacctggtgcagcggtattgccgccagtttccaagctggatcagttcagtcagactgtggcaattgcggttgctgaagatgcagtgaagcatggtctgaaccaaaagccgatcaaagatgctaaacaagcggttgcaaatatgacatggcaaccagaataccggccactgccggattcactcgaaatggacttgggggaataaacgttgactgcattaagtacatccattcaaagtgttctgacgattgttttgctgatcgtcgtaggttatgtgttgcggcggcaaggacgctttgatgatcaatttggtaaaacaatttctgatttgttaatgaaaatcgccttgccagcatcgattttcatctcggtcttgcaacgcctaacgttggataagttggtgagtctgtcatcaggccttgtttatggctttggtgccgtcattttaggctacctaatcgctttcttactggtttggttattaaaagtgcgcccaggtcggcgcgggacgttcatcaacatgtttgtgaacgcgaacaccattttcatcggtctgccacttaatctcgccttgtttggcgataaggcggttccttattttctcatgtattatgtggtgaacaccgtgtcgacgtggactgtcggggccttcatcatggcgtgggacgatccaacccagaagaaatcagaaaaaagcagtactggtttcaactggaaaaagttgttgccagcaccgttagtcggattcttagtcgctttggttttcctgttgttgaagattccgtttattcacgtcggttggttaagctttgcagtgaatgcccttgattatgtgggcagtttggtcacaccgttgtcattgatttacatcgggattattttggccgatgccggtctgaaagcgatccgctttgaccgcgataccatcgtggctttgattggccgttttgtcattgcgcctgcattaatcgctggcttgattctgctggggatgcatgctgggttcaacgtaccaggtcttgaagcgcaaaccttgatcattcaagctgctgcgcctggattggctgtattgccaattcttgctactgaggcgcatgccgatgttgagtatgcgacaaacgtggtcacaacatctaccgtcttgtttgtggttgtcgtgccaattttgatgatgctcgttcagggcttagcttaaacgtacgaaaaaagaagccgatcatggcttctttttttgtgcgattaatgttgatgagcttctagataggctaaagcgcttgtgtaatcaggctcatgtgtctgttcggtgattagttcacgatatttgacagtgccggtgccgtccacgatccaaacgctgcgagcatcggtgtgattatcggccacaaacaagcccatagccttgccaaagtcgccattttgatcagacaacaactgcatttttttcacgccttcagcggcacaccacgactgttgttcttgtggggtattggttgaaattgtatagaagtcagtatgatcaaacgcatccatatcttcattgaagtgtttggttgagatactgcaaacgcgtgtgttgatgtctgggacaacgctgattaacgttaatcgcttgcttaaatcctgcgtagtaacgggttttgcctgtgcattagtaacggtgaacgtcggcaactgctcgccgagttcgattggtgtaccattcgttgttaatgcttcgccatgacgggttatttccaaaaggctcactccttatatcgttaatgtggaatcgttcaagttcagtatcagtgtaccacgattctgaatgccatcagtgtagcatgcatttggatgaaacgaaattcgaacaattaaatttgctaaaattcattagcatatatattgacgcgaatataattatttatgtacattaacaataagcaaaatcatgccagatttttacaattgacgtaatcgaaaatgttagcgagcaaataaccggcactgcaggtgcgagaaggaggtggtcgaatggaacaagcattggttgtttacgcttcggagacagggttcacgcaacggtttgcccttggcattgcccaagcactgcattgtgaattaattgatgtgcaatttgtcaccactgcagacctgcaaaaacgcaaacttatcatctatggcggccatctcgtaggtgaaaaagtcttgggtctaaaggccttctaccgcgaatttcaccagtctttacctgatcagttgatagtctttggtagcgggattatccgacgggaacaagtggcaattaagcaaatcaagctacagtatcagaaccgctgcgtcatgcctatcgatttttattacttacaaggccaacccaagctaagtcaaatgaacctttttcggcgtatccagacgagccttgctttaaaacaattaggcgccagtcattgcccggcaattcatgaaaccattcaacctcttttgagggcagtggtgcgcttgttggatcaggcaaatttatgatcgataaaatcgtaaaaaaagccgtcacttgggcggctttttttgctggggtactatgatgcgaaagtatttgtaagtagacgaagcgacatcagccttggatgagcatttaagcgatcaattacatgctcatcttttgaaaagtcctgggacgctcattgaggtcgcacatcatattagcgaaacatggcaaaaacaatatgatcaggtgattcgacttgacgagcttgctagtcagcaataaacgcgaaaccgtttataacgaagaaaaagactgggaattagcgatcaaccgttcattgcgccggaatggcacaatttagcggtgatggcttttcccagcctttcatgatgaggggctacttagaaattgtggtgctaaatgcgtgaggcagttttttgttattagccattgatttcatgactcagtgaaataatctcatccactgttctaccgaggaaggcaatggtttgcttcaaggcggcatctgtggtgacatcaacaccggctacccgagcagcagcgactggattgagtgagtcgcctaagcttaagtaacgcaaccagcggtcaacggcaggttggccttgttgttcgatggcttggaatgcctgagtagcaaccgtgagaccagcggagtacgagtaggaatacaatcccatatagtaatggctttgtcgcatccatgtgagctcggcgccttcttctagttcaacagccggtccccagaaatcagtgagcacctgacgtttgatggcattcaacgcagctgcatcgaaactgtcgccggcgtcaatgcgttggtaaactttgcgctggaacgcagcttcaagtaagtgggtgacaaagttatggaagtaggtgtcgttgagtaggcgggacaaggcgaagcgtttcatctgcggatctttagccgtttgatcaagatagtgggttaataggagctcattgaaggtcgaagggctctccactaaatagtcattgaaatcagcatcgagaatattgtgtgctttttcagagcgaaccatttgtgccgtgtgcccaagttcatgaattaaggtgtaaaccgcaggcagggaattactccacgtcatttcaacataagggtgaacgccatagggacccgcggtgtaagcaccggagtccttgccttgattggcagggaaatcaatccagtgatcggtgaacgcctgcatcatttgcgcttggtaatcatggcccatgatggcggtcgccttttcgatgtctagcttggcctgatcaagcgtaatcgttggagagtaggcaggatcgatatcgatctgaaggtcggtataaccgatatgatcaagtccccacaattccttcacgtgggtgatatatttgcgcatgatcggtgccagatcgtgcataatcacgtcgatttggcggtcgaacatggcccgactgacttcctgatcggccagcaaataatcgatgacggaatcatagccgcgcatggtggcagtgattttttcacgagtgacttgtgctagataaccagccgccatcgtgttttgataccgacgcaatgtctggttgaactttgcataggctgcacgccgcacttcggtatcaggatgcttttgataattttcttcatacatcacgaatgacagcggataggttttaccgtgagccgtgaaggtgccaaaatccatatcgccgaaaatcgtttggtcgcgaatattgctaggcgcttggaaaacaggtgataactcggctaagaccttctcagcagcaggagccaaagcgccttttttagcaattttgatttggcggaaaaagccagcatagtcaggtgccttggcaacaacggcatcaaggacctcttcaggtaactgggttagttctgcttgaaagaagctcaattgaccaccaatttcaccatctaaagccgtggctttgatttggcgatcacggagtttaggatcagtggtatctgtcgaatacggcataaatgcccagtgtccaattttactatcaagttcgataatcgagccatagtcgcccagtgcatcaacaatgatggccggttcggtcaactttccttgatatagatggacaaaatccttggtcaaagcgcgtacttgcttaatggcttcggtgtaagcaaactcatcagcaaaaatcggcgttaaatcccaagtcagttttggatcaacctcttgacgttttggcagtgcggtttcactcatcgaaaaaacctccttcgcttaatgggtaaagtatagcattggtctgcatgattttgttctgtggaatcgcatggggtagatggaaacgcatatccacaaaaagcgactcgtggtaaaatcattaaaaaggatgtgttatatatatgggaatcgacaataatcagctcgtggcgcgctattttgatcgcaaagctgatcatgcagcattcttcaaggcgttagaagcctatttggatgatcagattaatgaactgtatacaacgttgaatgatactttcgcagatacggtgacgctgtcattagatgtggccatcgctaaggcgcaccaagccggcgccaagattgacgatccagcggctgaagaaattgcggcaactaactatttattcaaagaactctcttctcgcggcttgtggctgcaatcacctgatcaaaccgaaccgaacaccatcatcgctaaattgaatttcggtaatcggcggacttactattaagcctgattgatcatcaaacgagaagttgagacatcattcatagtaaccaaaaagaggcatgattttctgattagtggaaatcatgcctcttttattgagccttatggataactgatagcagctaaagatgccagtgttaaagcagagattgcaaagtctggcactgggaaaaacctttttacatcaccatggcaatttacccgcggtttctgtaaatgtcatattcaaatcagggctatcgtcagcggcgagtttgacgatttgagcagcaccttctgcaaccgtttgttcgccgctacgattaccaccaaaatctgtgcgagtccacccaggattgactgagttgacactaatgtgatctggctgtaactctttggcaaaatcaatggtggcgaagttcaccgctgcttttgaggcttgatatccaagtgaattcacctgaaagaagcgactgtcaggatcgctagccaaaccgagtgaacccatgttgctgctaacgttgataattttagctggagcacccttttttaacaacgggatcatcgcctgtgtgacactgactaagccgaaaaagttgacgtcaaagtcttgacgcattgtcatcacaggcaattgtgaaggtggttgatgggcatctaaggcaataccagcattattgatcagaacattgagatagccatgtgaggcttcaatttgtttcgcggccgtcgcaatggtgccggcttgggtcacatctaagaacctgtctagtatcttttaagaactatcttcaggaaggccaatacaaccatttgaagactgctgttaagggcacgttcacagtttttccaaagtcgccgacatttgtctagccaactccatgaacgttcaacgatccatcgttgcggtaacaccgtgaacatatgcaactcgttgcgtttagctaccgtcgtcttagcattcaaaatgagcttcacctgatccgcaaagtcattgccagtgtagccaccatcaaccatgacatgctgaaccagctctaaattttggctagccaaactaaacatagccaatgcacctgaacgatctgatacattagctcgtgtcacgagaatggcttgtggtaaaccattaatatcaaccgccatatgacgcttaatccctgaaatctttttgccgccatcgtagccactatttttcgttaaatcagtggttttaacactttgagcatcaacaatcacaaacgacgttcgggccgatcggccctgtgcaaagcgataggaagcgacagtttttttaaaagcctttctaatagcgaatcagctgtcgggtctggtttatctcgccacatatcgtaatagcggtagacggtatgccattccgggaaatcgtgcggtaattcacgccattgacaccctgtagtaagcgagtaaaggatggcattgaatacgtcataaagatcataacgacgcggtcttgtatgcttacggaagttttctaaatcaggttgtattaacgcaaattgcgctcgagaaatattgcttggataatctggcatgacaaactcctcagtcggttttccacaattctaccagattcagcagatactagacaggttctaagatgaccaattctgccgatacgccagctgtgtgcaacttgttaatagcctgttcaccgcgtgcctgattgcgcgcaccgacaagtaaatgctgaccgcgtttaccaagcgccattgcggtttcaaagcctatccctttatcggcaccggtgatcaaagttaacgtctgtcgtttaaccatgatcctcacttctttcaattattgaccctatttttctggctgatgaggggcgtattgacgatcagggaaccagattggaatttcacgtcgggcacttgtctcactatcggaactgtgaatgacgttgcgaatagttctgtcggcccattcacggccaaaatctccacgaatcgtgccgggcgctgcttcggcgggattcgtggcgcctgtcattttacgcaccgcttcgatcacattgaagccgctcacgatcattgccaccatcggaccgcccgtcatgaagcgttcgattcttggaaagaaaggctcgccaacaagtgctgcgtaatgttgatgtaactgatctgccgttgcatgtgtgactttcagcgcatcaattgtgaagccgcggtgttcaatccgcgtgatcacatccccaatatgtccgtttgcaacaccatccggtttgaccaagactaaagtttgttcttctgccatgtgtgtgtgcctcgtttccttaactattttcagaaaattcctgcaatctcagtatacacgagtcaccgtcgaacaaaaaaggtcgatgggtattttcatcgttttcatcgccaattgatttttgacaaaacacggcgaccaagaaattcttgaattaacaagtaaaacggaacagttgagatcatgagtggcaaataaattaacgcgagctgccactgccagagattgacaagtgaaaaaattgagctgaagacgaagaagacaagaaacagggcaatgctgagaccacccagtaggccaaccttgagtcggttgaaaggtcgggcaacgacgagcagaacattcaatgaaatagtgccaatcaacatggctaccattgatgaagtagactcaaaactcaagtggaagaaagactccatccatgtcagcagtaatgtgtagatgacgacactaatggcagcaggtgcggcaatggtcatgaccttctgcatgaattgaccagtcacgcgttcgaagtttggttccaaagtcaggaagaaggaaggaatggcaaccccgatagcagaaaccggtgtgaggttaatcggtacaatcggataatcaagtggcaagaagacaaaaatggtggctaggatgactgaatacatcgttttgaccaaatacatggatgccacgcgttcaatgttgttgatgactcggcggccttcgtttagaacgccggtcatggcatcgaagtttgaatctaacaaaacgaaatccgcaatagagctggcagcatcggcaccagatgccatggcgatactgcagtcgctttggcgcaatgccaagacgtcattcacaccgtcaccagtcatggcgacggtgtgccccaaagcttgataggccatgattaaagatttcttctgttcaggtgtgacccggccaaaaacgttatagcgtttcacaagtgtttgataatctttggcggttgcgttgtctgcaatggtgctcatgtccacactttgatcagctccttcaaggcgagcttgcttggcaatgttggcgaccgtgatcggatcatcacctgagatgacttttaaagccaccccttgcgttttgaagaagtcgaacgtattaatggcagttggccgcaattcatcggtgatcaaaatcagaccgagcagttggggattaactaacggatgcactaatttggttgctgtgccaatggctaaaacccggtagcccttagcagctgcatccttaatttgatttgcaatcggtgctggtaattgatcgccgaatgtgaactgcggggcgcccataaacaatacttgaccatcaacaacggcacccgaccacttacgcgcagaggagaagggcattgtctgcgtgacttgctgattggtatcgttttggaaggcggctttgatggccattgctgtttcgttgtcgtcatttagagcataaacaatagcggcggcggctttggtgactgtcgcttcagtttgcccaatcatcggcaatgtttcggcgactttaagtttgccactcgtgatagtaccggttttgtcaagacagatagtatcaactcgtgcgagtgcttcaatggccggcaaggcgcgaacgagaactcgtttaacggcaagattgcgggcggatacggctaatgccacatttgttagcaaaaccagaccttcaggaatcatgccgatcatggcggcactggttgttaaaatagcccgattatagttgcctcggcggatcatcgagacggtgaaaagaattgcgccaatcgggataagtacataagttaacacgcgaatgatgcggttgatcgttgccaacagttgacttttgctacctttttcggctttggctgccaaagcaagctttgccgcaaaagttgcggcgccaaccgcggtgacttgcatggttgcctgaccggaaacgataaatgcaccagaaagcagcttgtcgcccacttttttagtgatgggtcgcgactcaccagttaagggactctcgtcactttcgagaccattcgttgcgacaaccacaccatcgacaggaatctgatcaccgcgtttcaggtgcaccatgtcatccataaccaattgttcaagctcgattttttgtgttttaccatcacgaatgacggtggctcgagcagctgccaaaattgacattttatcaatctggtgcttcgcctgaatttcttgaatggtcccgatcgccgtgttgatgatcgcgacaccgagaaagagtaagttcttataactgcctgttgtcacaatcaaagcacctaaaaccacgttcaccaagttaaataaggtgaacgtatttactttgataatttggctaattgatcgcgttaatggttttaacggcaagttatgttgacccgcggcaaaccgttcttcaacttgctttgttgataatccctgatccggcaaaatgttctgctcagccatcgcatgccctccaatgcttttcattcattttaccaatcaatcccggtagatgacgaataagcgacctgtttttattaaactttgaagagtcttataagattccgaagtggcttaatgttgttcatcaaccacgaaactcgcataatggaagacaaatgacaagaaagaagcggttgtatgccaaaacttaatccagacgggacgcaattcatcacgttattgagtgggtaccatttgtggacacagacgcagggaaaaggtgatatccatctcatgaccttgcatggtggcccaggcggcaccaatgaagtctttgaaaattttgctgagcggctagcgccttatggtgtgcgcgtgacccgttatgatcagttggggtcattttactccgaccagccggatttctccgatccggcaaatcgtcagcagtttctgaacactgattactatctgagcgaagtggagcaggttcgacagcagcttgggattgaccacttttatctgcttggtcaatcgtggggcggtgtgctggcaattgaatatgcattgaaatatccagagcatcttaacggagtcattctgagttcgatgattgacaatcttgacgaatatattgtgaacatcaatcggattcgggaaactatgttttcaaaagaagatgtcgcttacatgcagcaaattgaacagcagcatgcgttcgatgatgcaaaatatcaggcgcttgtaagtgagctaggcgaacactacttgcatcatgcaaaagatccccagccgcgtcacttaatcagtacgctggccacgccagtttacaattattttcaaggcaacaatgaatttgtgatggtgggtgcgcttaaagattgggatcggcgtgcagatatccaccgtatcgccgtacccacctacctgacgtttggcggtcatgaaacgatgccgctggcagccgcggaacgcatggcgaagacaatcccagacgctaccttacatgtcacgccgaatgctggtcatggacaaatgctggataaccccactgactatttcagtcatttaggtgattggctggtcaaaaccgacacgaagacggcttttcattctaaataacgttataataagaatggtaaggtaagtttttcaaaatatggaggtgcttgcatgtctgaatatgatgaattaaaaacaagcttgttcgaacctgtacgagcgtttgatcgggcattggaacaacagccggatttaatcattccattggcagttgttcacttgattccaattgctctgacacttggtggcgggattgctatcattcggggtcaccagaaactgcgtgccgaaaaagagcgcacgaagcagttgagcttgaagctggaaatgcataaacatcatcatggtcggcgtaattggcggctggcgccagaacatcgcggcgagcaggatgtttttgctccagaatatttggagaaaccggctggtaaaaatcgtcacgcccatcgtcggcattaggttgatttgatacatgaatagatcaaaagcctgagcaattatctattgctcaggcttttttgcttaagtatgcgcagctttacgtgttcatttttcacctgtgaacatgtttatcgccgtgtccagagccgtatttaaaaaatttttttgcccatttttttacatattactaaccacaaaaactgccgcgcacttttatgcgccgtcattgaaacgggcgacaagatgcgggacaatgggtgcacgataatttaggagatgatgttgatgccagttatgttgatgcgtactgctacccgagaagatattcccgcgatgatgaagattattgcttctgctcggcaatttttgggcgaacaaggtatttcacaatggcaaggaacctatcccgatcaggctgcggttgaacaagatgtagcgacaggcatcgggcgagttttggtcgttgatgggcaggttgccggcatagccgctttggtggaagggcctgatccgcattatctcaaaattgatggtgctggttggttggccgatgtgccctatttggcagttcatcgatttgcgcttgatggcagcattcgtggtcatcaattaagtaaagttttctttagtaatattatgactgaagcctatcgacgcggtgtctatgacctgcgcgtggatacgcatgcccaaaatgtgatcatgcagcatgccatcaccggaatgggcttcgaatatcgcggcattgtttacatggatgaaccggttcctgaacgcaatgcttatgaggttcgtttggcacactaacagaaagacacgaaatggaggagatcgacatgcaggacattggcaacttggcactgatcttagtcacaacgctggttttagcgcatttaagccgattgttgaatatgcccgctgtcattggggaattattggctggtattttgattggaccggcgttattgggctggttggcaccaagtcacacgatttcattatttgcggagattggtgtcattattttgatgtttcttgctggcttggaaagtgaccttgatttattaaaaaaatacttcaaaccaggcatgttggtcgccatgatcggcgtcattgtaccggtggctgttgtgttcgtttttggacgcagttggggcttcaacatgacaagcagtctattcttaggcattacctttgccgctacttctgtttcgatctctgttgaggttttaaaagagctacatgccctagaaggccgaaatggtgcgaccattctcggtgcggcggtggttgatgatattctcactgtcctcattttaagtttcacggtagcagtccttggtgagcaaaagaccgcgagtttgcctttctgggtgcaaatcattgaacagttgctctactttgccggcatttatttggttgtcaggtgggctgcgccatacttaatgggtttggccgaaaaaatgtttccgtcgtcggctgtgaccattatgtctctgctcatttgcctcggtatggcctatctggctgatcttgtaggaatgtccgccgttatcggcgctttcttcgctggcgtggcagtaggccagacacgtcatcgccatgaagtggatggtagtttgagtgcgattgggtatgccgtgtttattccggtgttctttgtcagcgtcggcttgaatatgcggtttgatacctttggccgcgatctagggtttattgcgattttgaccttattagccttagtcacaaaatgggtcggctgtggggttggtgatcgtttggccggtgcgagttggctacagagtaatgtcgtgggtgccggcatggtttcccgtggcgagatggcattgattgtcgcccaaattgggttcgaggccaaactcatggacgctgaatattactcggcggttattgttgtgattgtcctgacgacattgattgctccaattatcttgaaagatgcgctacggcgtgaacaggaacctgtataataaagatgcgcgtctatttaacgcgacataaagccgagcgtgcgtgcgagttcttaaaaatgtgttgactgggcaatcattgcgggactggcggccgcgtttatgagggggattcaaatggctaatttgttttttgactttgatggcaccgttgctgattcggaagtcggtatcgttgcaggattgaaatatatggttcaggatcgcggattgcggccgctggacaattcggcctacacgcaatttatcggaccagcgctgattgatatgcttcccaaggtttggccagaacttgatgacattgaagttaagcgagccattgatgctttccatcattattacgaagaggaaggcctttatcaggttgaattgtatcctaattttctggacacgatggcaaagctcaagcaacaagacaaccaactttacattgcctctgctaagccagaaacaatgctgcatcgccttgtaaagcacttttcgttggaccaatattttgctggtgcgtacggtgcaagtgacgatgaggaaacccgggtcacgaaaaccgatattttgacctatgcgctaaaagacagtcaagttgcgctcgatcaaagtgtcatgattggtgatcgggccaatgatatgattggtggcaaggccaatcatgttcaattgctgggtgtgacgtacggctttggttctgctaaagaactaaaagaagccggtgccaaagtcttagttgatcaacctgcagatattcctgcaggactggcgaagctagcaaagatcaacgcaaaatagtgccctaatcaagcttgattaaggaaccagacaaaaaagacgtgcctgtaaatggcacgtcttttttgtctggcacgagataccgaattattgatcgtcctcagaagtttgttggggatgaatcagtttctcaccaatttcattgagcaagtcaacaaactgtttggctttgtcctcgccaagtgcagtaacccactgatcgaagcgatcagtagcagttttagtgatctccgcctcaacttgttttccaagcggcgttaatcgtaaagtgttacgccgacggtcagctgcaaacttggtctgggtcacgtaattgagattgcgcagtacgcgcagttggcgggccacggccggtttcgtgacgcctcgtttggcgacaatggcagtcaggctaatatcgggatcatgggcaatatcagatagaatccgaaattgttcaaaactaagatggtattttgccatcggtgccgagattagctcattaatacttttgaatgttgaaaaataggcatccacatatgcctgtagcaaagattcatcagtcatctttcttcctccaaagtttatcttaacaaatcataccgcaactgtaacttgaaattattaaaagttgcggtacactttttagttatgtaaagggctttaactacttatggaggctattagtgtgcgaaaacataaaaaagcttggctgattgggctgttatcaatcttcggtgttctgcttatgggattagttggcgccagtctgtatttctaccaatatgcatttgtgccatcaaaaaaatcttttttgagtggtggcgaaagtcgaattgtcaaggacggtaaggcgtggcttaaaaccgttcataaggaaacgtggaccgaaaaggcggctggtgccgatttgaaactggttgccgactatgtgccagcggcgaaaccaacgaacaagacggtggtggtcgctcacgggtacatgaacaccaaagaattcatggcgccgcaaatcaaaatgtttcatgatgcagggtttaatgttttggccccagatgatcgcggccatggacaatcgcaaggaaactacatcgggtacggctggccagatcggctggattatttgaagtggatcaatcaaatcatcaagaaacagggccagcaaagtcaaatcgcgttgtatggcgtctccatgggcggcgcaacagtgatgtatctgagtggcgaaaaattgccatctcaagtcaaaagcattgtcgaagattgtggctataccagtattattgatgaactgacttatcaagccaaagcaatgttcaatctgcctaaatggccgctgattccgtcagtggcactgacagccacgatcaaagccggttataacgtatttgatgccagtgccatcaccgcgttgcacaaaaatacccgccccattttgtttattcacggcagcaaggataagtttgtaccaaccagcatggtgtatcaaaactaccgagcagccacaaaatccaagaaggtcttgtgggtcgttaaaggggcagggcacgcgaagagttttcctgatcatcagcaagcctacagcaagcgagttgtcggctggtttaacgcaaactggtgaagcgcagcgttactgggcggcattggtggcagcaacccgctttaaaatcgcgtagattttctcagcatcacttggggtcccgcgtaattcgtaatcggccaagaagggcgcatcgaattctttggcatagcgtttagccgtgagacagtattgttcgttaaagttacgattgccggaaccaatgatgccaatgcattgatcagcgttttcgccttctgccagatagtcacccatggcagtggtcatcaactccttgacgccgttatcaataccattaccgccgtcaagataagttggcaccatgacaaaaaatggtttggtttcaccgtcactttgtgtggcatcagaaatttctttcagcacaattgttggattagcagcattctgatcatgttgcgtttgtgcatagactgccaagcgatgggcaaaagcccgagtattgccagaaatagaaataaataaaacgtggataggttcagtcattgtgatggcctcttttcatgattgtgagcatggcacaagcctttgcagtcgcttgctttttgccgatatgccaaacgaagaacagctaaaaagagtcgcggtacagcagccaagtgcttgcaccacggctcttttttgcggcgttagaattcttgataaactgccggatcttgatccttgagccgaccatccggttttgtcagactgtcaatggcggccatttcttcgttcgttagtgtaaagtcaaacacatcgagattggtgcgttaacgggcaaggtgtgcggactttggaatcggtaagatctgatgttgcagatcccagcgtaagacaacctgaccgacatttttaccgtgtgccgcagcaatttttttgatgcttggttcctgtaaaaccgcgccgcgacccaatggactccaagcaactgtttggatattgtgcgccgcgtcatactcacgttgcgcttgttggttgaagtaaggatgcaactcaatttgattaacagctggcgtcacgtcggtttctttaattagccgatcaatatgctcaggtaaaaagtttgaaacgccgattgagcgaaccaatccaaaccgttgtgcctgaatcaaggcttgccaagcttccacgtaaagatcctctttaggatttggccagtgaattaaatagagatcgtaataatccaaaccagcacgataaagactttcttcgatggtatcgatggcttcttgataacgatgatgacgacctggcagttttgaagcaatcgttaattgactgcgcggaatgccgctttggcgaacggcctcaccaacggcaccttcattttcgtagttaaaagcggcatccaacatgcgatagccgacattgacggctcccaccattgctcgaacgccattagcaccattaagtttgtaggtgccaaaaccgattgctggtaagacgttgccgtcgtttaaggtgtaattcattcttgtgaacctcctttaagatgtgctcatagtcaaacaggacacagatgactagctgatgggattgaataagtgctcggaccaatcagttaagaaaccaaattcatcagtgcaacagttcctatacgtcgctgcgtccgcttttttaagctgcacaacactatatatagtgtagtccaaacctagtcatgcatacaagcatcgacaaaccttcgtgtataataaagccaaaagatagcgcgcaaaccagtctagtttctgtgctggtaggagttttacgcgtttacaaagaggggattatcacgaaaacacagcaatggcgagccgtttcacgaagctggtttgcactattcacgatgattttttgggtattattatttgtcgaagcttttagtacagggatgatgctcacaattggctcaccagtgcggaccgaggcggttatcgtcaagagtaaaggcctagatcaattgacgcaaacgttgaatcagcagttgttaacaactgcagcgaaaagtggggcatcactggataaaagaacagtgctcgtcactacagatgatacccagagactggctaagaatatggtggcggccagttcactacatcagccacatgtttcgttgacgaccattgaagagagtgtcacaagtcgcttacaaacggcagcgactgtgcagcatcaaaattttgatcaaaaaaaagtactcgccagcttgaaaacaacgcttgagcgcgaaattaatttacacgtgatggcacaaggctggggattagtttatccattgctggttttgatgacgcaaacagctgtgattgtcgcggtgatcctgatggcctttgttttgctcattatgatcaaaaccgctcattcatggcggcgtttcttagcagtaactggtcgttcgacctatgtcatgggatatgttggcggattcatggccatgtttgtcaccgcgaatcctttcttaggtgctgtcgtatcacgcattgcgattaatcaacaactgacacgtgatctgattctggcttactcgccattatggcagcgcgtcgcaggatggacgattatcatcggtttgcttgttgcgggtgtgagccactttttcccgcgcgctcaggctgaggacgatgacttattaacggctgaaaggagtgctttatgaaactaaaacgctgggttgttatcgtatttgcggcggttgtggttatcgctggagcgggttggtactggtatcaggaacaacccaccgatacaccgacgacagagaaaacgacgattggtcaaaccgcaacgctatacttgcatggctattcagggggtgctggctcgactaataccttgattcgacatgctgagcagtctggcgcaactaaggtgctcacggccactgtcgctaaaaatggtaaagttagctggcaaggaaatgcacggcatgtcagcaagccgatagttcaggtgatttttcaggataatgtcaatccggattacgccaagctagcgggttggttgacgaccattaatcgcgaactttatcaacgttacggcgttcgccaggtcaactttgtggcccattcgatgggcaatatggcagtgatgttctatgcaactcaaaactcagatcaccctaaattgccaaaaatgcgggcttacgtggcgattgctggccattttgacggtattatcggcatgggcgatgagcctcatcgtattaaacttgctccaaacggttatccgacgccgccggatgagaattatgccacgttagccagaatgcgcgatcgttttccaaaaaatgtgaaggttttgaacatttatggtgatgtggatgatggttcagactcagacggtcgtgtcgcaaacaattcatcgcgctcattgcagtacctagttgaagggcgcgccgccagttatcaagaaaaagaatttgttggcaaaaaagcgcagcatagtgcgcttcatgaaaatccacaggtggctaaggcggttgataattttatttggtgagggtatgcgctagtttttgttagggtcgtacggcgtgacaacgactttgccactaagatagttggccatgtaaacgtcgccagtttcatagccttgctcctgtagctgtgctttcagccagtcttcatcatgatcactggcatcaagtgcggcgggatcaatctggccatctagaatcaacgggtatttgatggtttcatcgcctttgaggatgacattaagctgaccattttgttctagataggcttgccgaacgtcgcgaagatcgtttacgccagcagtacgtaatttgtaagccaaatcatttgccgaaagaccgacttgagtcgccgtctctacacgaattttgccatgctgcacgaccaataaaggctcgccgtcaatcagacgcttgatccaacggttatggttagttaagtatttcgaactgaaaacaatgagtgtccaaatcagcagtacgtttacaaattggagcaagccgatatcagtattgtaaatcaccccgccgataataccgccaaggacgtaattctgcatttgatcaacaatcgttgctggggcaaggttacctttgccggtgagcttgatttgggcaacgaacacaatgaagcctagtaagagtttcattgccgtgatgaaatatggatctctaaaaagttgcatgacagcctcctacttggtcacaaagtttgcttgaggcacaatcaaggtggttttatctagctggtagctattgttgtccgcattgatcgtcaccgtaaacatggttttcgttgacttaccgatggtgacgagcatgccagtgtgaaccgtgttgctgttagcatagacttgttgcacacccacctgtttttgcttggcaacactgcgcaacagtgtcgcgactgcctgtgaatcagcggttgcggtgcggcttgcttgcagatcacgaatttgaatgccgatggttaatagttcaatcaacgcaactaaaattaatagatcgcgatatttgtttgtgtgtttgtggcgcaaaaaatagatgagataggcgacaatcacaacagctcctgccatgatgatgatgtaacggaaggtactttgccaagtagtttggcgagttaagacgctgtaagcataaaaagttgttcccatgagacacctccaaaaaagtaactaccaaaagcataccagaaacagaacatgacagaagttattcttgacagtttgattggcggtgttatgataatgccaacttagacagacagattgctttgcggagaagagtacctgaagcgcagatcacaagcgagcctgaacagtgaaagcaggcgatcagttaatcagggaagatgagctccaaacagcttttcagcggttcacgccactgaaacgggcgcacccgttaccatgccgggtatcaaaattggtaccgttgaggcattggcatcaaaaccagtgcgaataagggtggtaacgcgcaaagtcgccccttgatcagaaatggtcaaggggcgacttttttgtgagcgcgagccagcccaaacccacttcccaagccatcgtaagcatcgccccctcccaacattctttccgcaaaagccatcactgcgtctgtcgacgaaaaataaggaggaccaccatcatgacagaaaaagttcaaataaaagctcctttccgcgccgatttagtcggcagcttgcttcggcctgaacgcttaaaagcggcgcatcaacaacttgcgatcggtgaaattaaacaagatcaggaactcaacattcaacacgcagccattgagcgtatcgtcaaacgacaagttgaacttggcttcaaagctgtgacggatggtgagttctcccgccgttattggcatctagactttttatggggcttgaacggttttgaaaaagatgatagttggcagtatgaacacgacttcaaaggcggcattaacgcagcagctaatgtgcatcttgctgggaaagtcagcttcaatcctgatcacccattttttgccgcctttaagtatttgcagagcattgtgccagaaggggttctccccaaacagaccatcccgagtcctgcattgctctttcgtgaccatcgcagcgataactgggcaaaatattatgacagatttgatgattatttggctgacgttgtccaagcctatgtggatacgattcaacatttctatgatttaggtgcccgctatcttcaaattgacgatactaactgggcctacttgattcagaatctaaaagatactgaaaatgatcccaaggcgcatcagcggtttattgacctcgctaaattggcacaccgcgtgatcaaggccgttttggtgaaactgccagaagacttgaccgtgacgtcgcatatctgtcgcggcaatttccagtcgacattcctgttttccggcgggtatcaatatgtggcagattacatcggtgatttgccgtatgacggcttattcctagagtatgataatcagcgttcggggtcttttgaaccgttaacaaagttgtggcacggcgatactaataagcgcattgttctaggcctgatcacttcgaagtttcctgaattggaagatgaggatgccgttatcaagcgaattaacgctgcgactgagtacgtaccgctgacgaatctggcgttgtccactcaatgcggttttgcttcaaccgaagaaggtaacaaggttactgaagatgaccagtgggcgaaactggctctggttcaaaaaattgccaagcgagtttgggcggatgcttagattgttttttcacttatgtttcggcttctgagcgctactgctcgcgctcagatttttttaacagataccactgttgtgttatatgataaatgtgtcatcaaaactaaaagggagatttctatattatggcaaaagttgaaagtttcaccttggatcacacagctgttaaagcaccttatgttcggttgattacgacagagcatggtgcaaagggtgatgtgatttcaaactatgatttgcggttggtacaaccaaatacagcagccattgatacggctggcttgcacacgattgaacacttgctggcatcattattgcgcgatcggatggacggcgttattgattgttcaccattcggctgccgcaccggtttccacttgattacttggggtgagcacagcacaaccgaagtggccaaggctttgaagtcaagtttagaggccattgccaatgacattacttgggatgacgtccctggtgttgacatcaagagttgtggcaattacaaggatcacagcctgttttcagcaaaggaatgggcgaagttaattttgagccgcggcatttcaaatgacccgtacacgcgtcaggttgtctgaggcttggtttcaaaagtatctcaccagctcgaaattgccgcataaaaatggcactgctacaactcgctaatgagtttgacagtgccattttcatgttcgaaggattattgaaataagtggattagccattgcccgccataaatcaaactcatactgtaggcgaggatcgtgataggtttgcctaaaataatgatccaaaaaaactttttaaaggtcattttagttaacccggcaagcagacacaaaacgtcgtcaggagcaaccggtaaaatgatagcaagcgtgaaaaagcgatcgaagcgttgctgatttttggtatagccgatgtatttgttataggttttttcagagatcagataagtaagcagcggcttaccaaatcgccgagcaagatggaaattgataaacgagccaattgcaataccgatgtagttgtaaaaaaagcctgtccatgggccaaacaaaatcacgccagccgccgtactgacaccgccaggaatgatcgggatgacaacctgaatgacttgaatgagcataaaaaataaagcgccggctattccgaggcgagcaatgtaagcctgcagagcattgatgtttgaaagaatacctaagtcataccagtaaatggctactgctgctaataagataacaacaacgatggtggcaaaattaatcagacgacgcacattttttggattcatctatttttggcctcagaacagttcatcatcaggaaaacatctatgctacaatgaatcaagcataccaaacatacgtactgaatggagagcttatgtacgagtattttgaaggcattattcaggcggtgaccccggcttacatcgtcatcgatgtgcatggcatcgggttccgtctgctagtagccaacccttatcattttgaagctggcgagcaaaaacgtgtttatgtgcagctgatcattcgcgacaacgaccagacactttatggattcgaaggtgctgcggataagcgtacctttaaccagctattgacggtcacaggcattggccctaagtcagcgttggccattttggcgaacgtgtctagcggcggcttggcgactgcgattgctcaagatgatgtgaagtttttgactaagtttcctgggatcggtaagaaaacagctgcccagattatccttgatctcaaaggtaaaatcacaacagatggacaaccagcggcagcagcgattgcgccagttgccagtgacgttgattcggaactcgcagatgcgttagcggcactcgtggcattgggctacccgcaacgcaccgttgatggtctcactgacacactgaaggcattcaatgccaagacaactgatgcctatttacgcgaaggcttgcgactattaagcggcaaggcttaggcttgattatactgaagctgaccgttgacgacaacggaagcggcttttgaagcacgataaaatttttcccgtgcttttaatagcatgttaactagagaggaagtgggtttttggcagacgcagacaaggatcgcttggtttctggcgacgttgacgattcgaatgaagcacagattgaaaaaagtttacgtccccggatgctcgcgcagtatattggtcaggatcgcgtcaaacatcagttggaagtctatatcacggctgccaaacagcgcgaagagtcattggatcatgttctgctctatggaccgcctggtttggggaaaacgacgttggctttggtgattgccaatgaactgggcgtcaatattcgcacgacatcagggcctgctatcgaaaaaccgggtgatttagtggcactgctgaatgaattgcatcccggtgatgtcttgttcattgatgaaattcaccgtctaccaaaaattgtcgaagaaatgctttattcagcgatggaagatttttatattgatattgtggttggtcaagggccaaccgcccaccctgtgcatttcccgcttcctcccttcaccttaattggggcgacaacgcgcgctggcatgctttccgctccgttacgtgatcgatttggcatcagtgaacatatggcgtattattctgctgatgacctcagtgagatcgtcaaacgatcagcaacaattttcgatatggcgattgatgctgaaggtgctcatgaaattgcccgacggtcgcggggaacaccgcgggttgctaatcggctactcaaacgtatccgtgattttgccgaagttgcggggcagagtccagttgatatacaaatggttgaccatgcgcttgaccagctgcaagttgatcagcaaggcttagaccaaattgatcgcaaactgttgatgttcatgattcgtgattacgaaggcggccccgttggactttcaacgattgccgctaacatcggcgaggaaatggcaacgattgaggaaatgtatgagccttatctgttacagatcgggtatttgaaacgaacgccgcgtggccgcatggtgaccccagccggatttgcacatatggggctgtcggctgagcaacattaggcaacatgctaaccgcgctggctcgcgctcaactataacgcgctccccagcgcagcaacctgcatgtaaggaccttggtcgcaatggtcaaaaaagcgaccatcacgtccaaggccgcttacactccggttgctaaccgcgctggctcgcgctcaactataacgcgctcgcagtcgcagaagcctgcacataaggaccttgaagcctaaatggccaaagttcagccatttaggcttcaagcccacttatgctccggcttctaagcgctcctgctcgcgctcactgattaaaatgaatggaagcgaatatggtgcaagagaacaaacgttatcacaaagtagaagacaaacattatcagctatcggatttcgattatgacctgccgcatgaattaattgcgcagacacctttgaaggaacgtgatgccagtcggctgttggtattaaattctgaaactggtgagatgcaagataagcatttttacgacattcttgattatttcaagccaggtgatgcgttggtcatgaatgatacgcgggtgatgccagcgcgattgtatggggttaagccagagactggtgcccatatggaagtgttattgcttaacaacacatctggtgatgattgggaaaccttgatgaagcctgcgcgcaaggctccggttggcacggtgattgattttggcgatggcttactaaaggccacagttaccaaggaactcgaacatggtggtcgaatgattcactttgactatgacggcatctttatggaaattcttgataagttaggcgagacgccattgccgccttacatcaaggaaaagcttgaagatccagaaatgtatcaaactgtttattctaaagagttaggctctgcagcggcaccgacagccggtcttcactggaccaaagacttgctgaaaaaagtgcaagaaaagggcgtcaagttggtttacttgacgttgcatgttggcttgggtactttccggccagtagttgaggaaaacatcgaagcacataaaatgcacagtgaattttatcggttgactccagaagcagcagcgacactgaatgatgttcgcgacaatggcggtcgaattattgctaccggtacgacatccattcgcaccctcgaggccatcggtaccaaatttgatggtgccatcaaggcagattcgggttggactgacatttttatcaagccagggtatcagtggaaggttgttgatgcgtttatcaccaacttccatttgccaaagtcaacgttagttatgctcgtggcagcgttcaccgggcgcgatacaattttaaatgcgtataagcatgcgatcgacgaaaaatatcgcttcttcagctttggcgatgcgatgttcatttactaatcacgaagctagtttctgctcactttagtgtgtttactagcccggcaacttgtctgtaaagagcttagccgcttactttcggggtgttaaccgctggcttgcgcgcaactatcacgcgttcgcagtcccagcaacttattcgcgctcactaaaaaatcggcttgcttaaatgcaagccgattttttaacggacgggatcacatcaacacataccaacagacatgtctcgatttttcttttaacgcatcgctgcgtggaacaacgtattcataggcgatcacaatggccgggtcaaaacccgggaagtgcgaaaactacggtaacggtgatcccgtccttagcttcattctaacagggatgatggtatgagaaaagcggaaagctcggactttcttgaagggtaagccaatcatgatatacatgcactcacttttaaataacaagtaactctgttaaactgacgtcacgagaaaatcaagcggcggtgctgcgagggcattgccatgaatgaggagaatgtatggaaccagcagttaagtatcgtctgattcatcaggataagcatagcggtgcgcggttgggcgaattgatcacgccgcacggcacatttcccaccccaatgtttatgcctgttggcacacaggcgagcgtgaaaacaatggcgcctgaagaattggatacgatgggggccactgttattttggcgaacacgtatcatctgtggttacggccggggccagaactgattgaagaagcgggcggtttgcacaagtttatgaactggcacaaaggtatcctgactgactcaggtggctttcaagtcttttcgctagccgacactagacatattactgaagaaggtgtcactttcaaaaatcatttgaatggtgccaagatgttcctgtccccagaaaaggcgatcgcaattgaaaacgcgttgggacctgacatcatgatgagtttggatgaatgtccgccgttttttgaaagctatgattatgttaaaaagagtgttgctcgaaccagtcgttgggctgaacgtggcttgcaggctcacaagaatcctgattggcaggcgctttttggtattgtgcaaggtgccggattcaaagacttgcgcgagcaaagtgctaaggatctcgttagcatggattttcctggctattcgattggtggcttgtctgttggtgaatcaaaagatgagatgaaccatgtccttgatttcactaccccgctgctgccggaaaacaaaccgcgctatttgatgggtgtcggctctgcggatgcgctgattgatggcgccttgcgtggcattgatatgtttgactgcgtcttaccaactcggattgcccgaaatggtacttgcatgaccagccgcggccggctcgtcattaaaaatgcgaaatatgcgcatgactttggaccgctggatcctaattgcgattgctacacgtgtcgtaactatagccgcgcctatattcgccatctgatccatgttggtgaagctttcggtattcggttgacgacctaccataatctctacttcttactgcacttgatgcagcaagtgcgtgaagcgattgccaatgatgatttgctggctttccgtgaagatttctttgaagcatacggatacaacaaggaaaaagcaaagaatttttagattatttggagtagaccgcctaattctgttacactgtttgttgacaaaataaaaataagaggtgcctaaattgaatggtaatatgacaatgatcattatgctgctgattttcgtgggcttcatgtattttggcatggttcgtccgcaaaagaaacaacagaaaaagcgtcaagaaatgttgaatcagcttaaaaaaggcgaccccatcatcacgatcggtgggttgcacggtgtcattgattcaatcgaccagcaagctgggacggttgtcattgattctgacggcatctatttaacctttaacttgagtgctgttcgcggcacagcaactcgtcctgcagcgcctgcaccagccgctaccgtgacaaaggctgaagaagcgcataatactgatgaacaacgcgaagctaaaccagttgaagaggcttcaccaaaggctgacgatcaaaccgatgccaaaagtgatagcaaggcagaagacgacaaatagattcgtcatctgatagagaattcaatataggtgacgtaagggaaggtgtttagccttctctttttttgcgttttaagagcggattggcgcccatcacggggagatgtcaaaacaccgcgttcttttttgataaatgactttaaaagacctctaagtcagaaaaaaactgcaaatttaccttaatagttcaaaaaaaatacaaagtgaaataagcaattaaagtcaatgaacacaacaatatcagtgagcaagtcgatttttcgtgaaaaaattcaccaaaattgtttacaaaatcacaaagaccggttatgatgttcttgtgaaatggttaacaaaaaattccgcaaaacacttggaggtaagctcatgttaaagaatactgcgaagactgctaccgaagttgatgtaaagagcatggttgacgaactggttgcgaatgcgcatgccgctttgaagatcatgaaaactttcgatcaagaaaagatcgatcacatcgttcatcggatggcaatcgctggtttggatcatcatatggaattggcaaaactcgctgttgacgagacgggccgtggcgtgtgggaagataaagcgatcaagaacatgttcgccaccgaagaaatttggcactcaatcaagaacaacaagaccgttggtgtgatcaacgaagacaaacaacgcggcttggtatcgattgctgaaccaattggtgtcattgctggtgtgacgccagtgacgaacccaacttcaacgaccatgttcaaatccgaaattgccattaaaacccgtaatccaatcattttcgccttccatccgggtgcccaaaagtcttcagcgcgtgcgttggaggtcatccgtgatgaagccgaaaaagcaggcttaccaaagggtgctttgcaatatatccctgtaccaagtatggatgcgactaaagctttgatggatcaccctggtatcgccacgattttggcaacgggcggtcctggcatggttaagtccgcctattcatcaggcaagccagcactgggtgttggggccgggaatgcgccagcttacattgaagccagcgctaacatcaaacaagctgtcaatgacttagtactttcaaagagttttgataatggtatgatttgtgcttccgaacaaggcgtgattattgattccagcatttacgatgatgtgaagaaggaatttgaagcccaaggtgcttacttcgttaaacagaaggacatgaagaagttcgaaagtaccgtcattaatcttgaaaagcaaagtgtcaatccgcgaatcgttggtcaaagtcctaagcagattgctgaatgggcggggatcacgattcctgataacaccacgattctgattgctgaattgaaaggtgttggcgaaaagtatccactgtctcgtgaaaaactaagtccagtactggccatggtcaaagcagatggtcatgaagatgccttcaagaaatgtgaaaccatgcttgatatcggcggtttgggtcatacggcagtcattcacacggctgatgatgagttagctttgaagtatgccgatgctatgcaagcttgccggattttgatcaacacaccatcttctgtcggcgggattggcgatctttacaacgaaatgattccaagtttgacactgggctgcggctcatacggtggtaactcaatttcgcataacgtggggacggtcgacttgcttaacatcaagacaatggcaaaacgccgcaataacatgcagtggatgaaattgccaccaaagatttattttgaaaagaattctgttcgttacctcgaacacatggaaggcatcaaacgggccttcatcgttgctgatcgaagcatggaaaagttaggcttcgtcaagatcgttgaagatgttctggctcggcgtgaaaatcctgttcaagttcagacttttgtcgatgttgaacctgatccatcaactgacacggtcttcaaggggaccgatatcatgcgctcatttggaccggataccgtcattgctatcggcggcgggtctgttatggatgctgccaaagggatgtgcttgttcaacgatgccggggatgctgatttcttcggcgctaagcagaaattcttggatatccggaagcggacttacaccttcccgaatctgaataagacaaagcttgtctgcattccaacaacttctgggactggttcagaagtaacaccttttgcggttatcaccgattccaaggctggcatcaagtatccattagctgactatgcattgacgccagacatcgcgattgtggacagtcagttcatcgaatccgtaccgccagtggttgtcgctgattccggtttggatgtgctctgccacgcaaccgaaagttatgtttcaaccatggccactcattacacgaagggcctgagtctggaagcaatcaagttggtcttcgaaaatctggaaaagagttatcatggcgacgtcgaagcaaagtcaaagatgcatgatgcttcaaccattgccgggatggcctttgccaacgcactgttgggcattaaccacagcatcgcgcataagattgggcaagcgttccatctgcctcacggtcgttgcatcgcgatcacgatgccacatgttattcgcttcaatgcgagtcaaccgaagaagcgcgctatctgggcgaagtatagctacttccgcgctaacgaagactacgcagaaatcgctcgctacctcggccttcctggcaagacaactgatgaattggttgaaagctatgttcaggccttcatcaagctggctcacagtgttggcgtcaagctcagtttgaaggaacaaggcgttaaaaaggctgatctcgacaagcaagttgatcgtcttgccgaactggcttatgaagacaactgcaccgttaccaacccgcaggaaccgttaatcggcgacttgaagcatatcatccttgatgaatatgaaggcaccgaatccactttctaagatgtttgctgctaatcatttcacaatgatcggcgcagagaattcaatggcgacattatttgagccgatcacgaaaaacacgtcagtaaattggcgtgtttttttgtgtgactcatggcataatggagtacagtgactgcaaattaaaagtaaggatgtaaaatgacaccgaataaagaggattatcttaaattgatttttgagattggcggcgatacacagctggtctctaataaacaaatcgttgccggtatgcatgtttctgctgcttcggtcagtgagatgatcaacaaactgggcgaagaaaaactggttgcgcacacgccttatcaaggtatccagctgacatcagctggccggaaaaaggcggccattttggtgcgtaatcatcggctctgggaagtatttctggttcagtgccttaaatatccagctgatgcggtccatcaagaagcagaaaaactggaacatgccttaacgccggaaatggccaaacggttgtcagctatgttgggcgaacctcgctattgtccgcacggcggtgttattccggatgccaatggccactatctccaacaaagtcgggtgacattaggcacgttagatgttgggcaaagtgggcatattgaacgcgtgattgatgaagtttcgttgattgattacacggttaaaattgacctgcggctggatgatgaattcacggtgactgcgaaaaccttagatgccgtgatcatcaagttagcccgtaccggaaaagaattggcggtcgatgcagatcgtgctgatcacatttttgtcgaattgtaattaagtctagagaaagcagggtcgtatacatgccagaagagtcacgtgctgtgattattatttttggaggttcaggagatctagcctcacgcaagttgtatcccgcactgtttaatctttaccgtcgtggtgtcctcgctgagcattttgcggtgatcggcacagcgcgacgtccgtggactgatgatcattatcacgaggttgttgaaaacgccgtcgctggcgatgatgtggatcgtgaccaagcaaaagcctttgcccagcatttcttttatcagagtcatgatgtaaccgatgcagatcattacattaccttgaaaaatcttgctgcaaaattggacgatcagtatgtgactggtggcaatcgcatcttttacatggccatggcaccagatttcttcgaaacaattgcgagccatctgaaatcggaacatttgctgacggagcgcggtttcaaccgattaattatcgaaaaaccgtttggtcatgattatgccagtgctaaagaactaaatgattcgttaactgcaaccttcgatgatgatcagattttccgaattgaccattatcttggcaaagaaatgattcagaatctgttggcttttcggtttgataatgccatttttgaaggagtctggaacaaggattacatcgacaatattcaaatcacactttccgaggcggtcggggttgaggaacgcgctggttattatgaaaaggccggcgcgttgcgtgatatggtgcaaaaccatgtgatgcaggtgctgtcttatctgacaatgccaaaaccaaagacttttacggctaacgacattttgacggccaaggatcaagtgtttgccgctttgaagccttatgatcttgcaactgctaaagaaaattttgtgcgtgcgcaatatgcaagcgccgaagtagatggcgaccaagtgctgggttatcggcaagaagaaggtgtggcagcagattcacaaacagccacttttgtcgcaggcaaaattatgttagatatgccgcaatgggaaggtgtgccggtttatattcgcactggtaaacggttaactcggaagtcaacccagctgacactgacatttaaaccggtcgcaagtccgttattcaaccgagaaaccggtagtcaaccagacagcttgaccatttatatcgagccaagtgaaggctattcgttgcaattgaatggtaaggcccttggcacaggctttaatattgaacccgatgagttgcggtatcgtcatgatccggaagccgccgctgctgctccagaagcatatgaacgattaatcaataatgtgcttgaaggcgatcagacaaactttactcattggtcagagttatcggcatcttggcggttcatcgatgcgattcaagcagcttggtcacaggaaacagaaatgccgacatatccggctgccacgatgggtccgcaagcagcgtttgatttgttagctcgtgatggccgccaatggttctggcaaccacgcagaattaaactggcggactaggctttcacagataaacaaaagggactgtgacccgaaaaggcggtcagggtccttttttagtgaacgcgagtcagcccgggtttctgggctgacgagcgcgttataggtggtccgagtagaatcggtcttgatcgttaaaagctgaacgtgaactagcgcgacagaaagaataacagaacagttgatacgaggaaggggaagctcatggcgttatttgaattaccattacaaaacgatacttcccggaaaatcattcatctggatatggacgccttttatgcttcaattgagatgcgcgataatccgcaattgcgtagtaaagccttggtaattgcccgggatccgcgtacaactggcggcaaaggtgttgtgacaacggccaactatgtcgccagacgttatggcgttcattcggcaatgccggccaacgaagccttgcaacttgtgcctcgctcaaaactggtgtttaagacgccggattttccaaaatataaagcagtgtccgcgcaaattcacgccttgtttcatcaagtgaccgatctaattgaaccagtggcgttcgatgaagcttatcttgatgtcacggccaacaagatgttcccgagtacgatcgccttggcattgtggctgcaagatcaaattagtcaggcaacgcagctcacaagttccattggcatttcctacaataaatttatcgccaagcaagcttctgattacaataaaccggttggtcgtacactggttttgccagaacaagccctattatttttggatcggctgccgatcaagcagtttcgcggggttggtaagaaaacgttgccgaagttaaccgacttaggtgtcactgatggcaagtctttgcgggccttatcgcaagatgatttgctccggatgtttggcaaaatgggatttgtgctttatcaacatgctcgtggcgttgacaatcgtcctgttgctgttcggacggcgaagtcaattggtaaagaacgaacctatggcacgcctctaactgacgccgaggcggttcagacacagttacacaatctggcagggatggtcgtgacatcgttgaatcaaaaagctatgcacggcaaaaccgtggtgcttaaggtgcgcgatgttgacttcatcacgcaaacaaagcggctaacccaagatcactacttcgaaggcgaacaagccattttcgatgcagcgtggcaactctggggcagtgttgccatgtcgaacttggcaatccggttacttgggattaccgtgaccgggttggatccgaagcagtatgagaatttggacctgccgttgtgaagacagacagcgaaggggtgcttgctgtaggggctttggtaacggcatgcgctactttgtgctaattaatgcggtttagcgcacctttttccataacgcgctcgccaacccagaaacctgcacgtaaggacactgaacgcaatgaccaaaacccggtcatcacgttcagtgccgcttacgctccggtttctaaccgggttggctcgcgcttcgtctgtcatagtacagccgtaacctatggtatactaacgatagattgcagtggggtgatggtatggcgacaaagcatgagcagattttggattatattgcaaacttggcggttggcaagaagatttccgttcggtcgatcgcgaagcatttgaaagtcagcgaaggaaccgcttatcgagctattaaggaagccgagaataccggctttgtctcgacgattgcgcgtgtcggcacgattcggattgaacaaaaaccgttaaatccaattgaatctgtgacattcaaaacactggttgatttgattgacgccaaagttttaggcgggcaggccggtatggacaagaaattggacaaattcgtgatcggggcgatgacaccagctgccatgcggccttacatcacgcgtaactcgttgatgattgtcggaaaccgtgaagatgcacaacggctggcactagaagatggtgctgcggtgttgatcaccgggggattcgaaactagcgcggcgattatcgctttggcggatgatcagcagttgcctgtgttgcaaactgcttatgatacctttacagttgcaaccatgatcaatcgagctttgtcagatcaggcgatcaaacaggatattttgacagtagctgccatttatacgccgttggcccaaattcaaaccattggtgttgaggcgacggtcggtgattatttgctgttgcccgatccgcgatatccattgccggtcgtgacgcgcaatgggcgattggttggcgtcatgcggccatcgctggttggcggtaagaagccgacggtgccgattgaacggttgatgcagaaggatccgcaaactgtcaaaccttaccttagcgtgactgctgtgggtcataccatgcaggataacggtttaacggccatgccggtggtggatgatagctggaatctgttgggaattgtgacccgcaacgcggttttttcaagtctcacaggcattgcccacagtcgcgaactatccaataccattgccgatcaggtcagcgctcaactgaccgccatcacaccgcaaccgccttacgttggcgggtacgagttgaaaaccgtgccggccatgaccaattcgcttggcactatgagttttggggtgctggctgaagccattaacggttgcactacccgttatttgcatgacacggggcggcgaaacgtgttggtcgaaggactgaatttaacaacatttcgacccatccagttagaaagtgtggtcaccgtcttgttacgtgaacttgagatgactaggcatgatgcgacgctggatgttgatgtcttaagcgacggggttcaggttgctaaagcgattgtgacctgccagctattagaaaggaattgatttttgatgattcaaaccgatattattaacgccatcaaggcaaacgatccaatcattatccatcgtcatgtgaacccagatccagatgcgttgggttcccaagttggcttagcagaaaccattcgcgctagttttccggataagaaagtgtatcaggttggtagtgacactggcaatttgagctggttggcacaggaacaaaccattacggatgacgtttacaaggatgctctcgtgattgtgaccgatactgccgatacgccgcgagtttctgatgagcgcttcaacaaggggaaaatgctgatcaaaatcgatcatcatccgaacgatgatgcgtatggcgatctcgtttgggtcgataacaacgctagctctgcctctgaactgatttacgatttaatcgccgccagcaacggtgttttgaaactcagtgataaggctgctcgcctaatgtacgctgggattgttggcgacaccggccgatttttatttaacaatacgaccccgcatacgttgcaggtggcggctgagttgattaaaaaggattttgatccaacagccattaataatcggatgaacacggtgacgttggcacaagcacggttgcaaggctatgttgtcgatcatctgaaaattaccccagcaggtgccgccagtgtgacggtaccacggaccgcgatcaacgagctgaaactggctgatgatcaggtaagcgctgttgtcggcacacccggccgactggataccgtcattgcttgggcagaatttattgaacaggcagaaggcggttaccgcgttcatctgcgttcaaaaggtcccatcatcaacacacttgccaaagcacacaatggcggtggtcatccattagcaagcggcgctaaggcagctaattttgacgaactgattcaaatcgagacgcaactcgatcaactggtcaaagaatattcgacctcaggaaagtaggcattatggagaatcaattcaaacaatttcaactaaaaccttttgttatcgatggtctcaatgcaatggccatcaccgccccgacacccattcaacaaaaagttattccggcgcttttgcgtggtgaaaacattgttggacaaagccagaccggtagcgggaaaactcacgcctttttggtacccttactcagtatggtagatcctaccgaagatgcgactcaggtcgtgatcactgccccttcacgtgagttagccaatcaaatttatgcggttgcccagcaactcatacaaactgagcccgcgattcggattaaccgtttagtcgggggaatggacaagcaaaagcagatcgacaagttgcaaaatcatcaaccacatgtggctatcggaacgccaggtcgaatcttggacatgatcaaaggctatgatttagtgccatcgtctgtccgtcattttgtagtcgacgaagctgacatgacgctggatatgggcttcctcgaaacggttgatgcgattgcctcgagttttccagatcatctgcaaatggctgttttttcggcgactattccgcaaaaactggaaccattcttgcgcaagtacatggacaatccaacgacgattgaattgaaaccgcagtcggtgattgctgacacggttgaaaacattttgattgcggcaaaagggcgcgataaaaatgagttaatctatcagcttgtcacgatggggcatccctttttagtgctgatttttgctaacaccaaaaccagcgtggatgctatccatgacttcttgaagcatcaaggtttgaaggtggctaagattcatggtggcattcagccgcgagaacgtcggcgcgtgatgaaggatgttgccgacctcaaatatcagtatgtggtcgccactgatcttgctgctcggggtatcgatatcaagggggtctcaatggtcatcaatgccgagattccgcgcgacaacgagttctttattcaccgagtgggccgaaccggtcggaatggcatggctggtacagcggtgacactgtacgaaccgggacaggaagatcaaattgccgaattagagcatatgggcattaagtttgcgccgaaaatgatcaaaaacggtgagcttgtcgacacttatgaccgcaatcgtcgagttcatcgcaaaccgaagcaagaagacaccagtcttgccattcgcggtttggtgaaaaaggcaaagcaaaagcacatgccgaattatcgtaaaaagattcgaactgcggtgttattagaacgcaaacgaaataccaaaattgctcggcgccaagcgctgttagcagaaaaacgcaagaaccgcaaacgagggtgagcatatggcagtcaacgacctgaccctgccgacctggaacacgctggatgaagcgcggcagaagtttatttttcagcaactcacacgatactttctaagtccgttattgtccgttgacgatattcggccgttgacggtgactttttttggccaaactttgcatacgttcgaggcaatgattggcggggaatggttacggttggtcccggggatgcctaatgttagtttaggttttgcggctgatcaacaagggcagttagctgattatttggggcaaagcggactaaccatgcaagacctgagccatcagctttcgcctgaacgacaagttgatataccagcgatgctcgtggcaacgagagcaatgccagcgagcgaagagattttaggccgagtcagtttaacgacacgtatttttaagggcaatcatatggcctacgcggctgttcgtgctcaagtgctggccttgctggaccgccatggcagtcttgatccgttttctcaatccggctggccagcaactttgactagcggatcggtgattctgcgacttgccagtgcgcaccattatcaggtcagcatcagcaaaaactggcaaaaatctgagctgcaaaaagcacttagttacttcggcttccgcctgccaacccaagatcaatatgaatacttgcaaggcgggggtgtcaccagcctattttcattcggcaataccctgccagccgacatgccacgctaccttcccaatcgcttcggcctaactgttccggtcacgcgatccggcagtgagctaatccaagaagcgatgcaaaaaagcacaccactttccgcgcaaccaaccgcaaaagaagctttggcactgtcgccgttttatcaggtggcaggcgaagggaacatgggcacggctttatatcggcgcgtggcgacaattacgatggattgagaatctgtactcgttggcgtttgaatgcgtgctaaacactcaggatgagacaataatcaacaacaagttgaccctttttttcagaaaagctataatgagttttcgttaggacatgcgttgaaccctgcacgagacagaaacgaccgcacagctgagaacggtcgcgtcaggctaagatgtgctccctgatattagttaaacgacaattaatgaagtggtaatgactcgcatcattgcaaccaaggtggtaccgcgtgcaagcgcccttggcagcaatggtgctttttattttgtgagcgcgagccagcccggttagaaaccggcgtgtaagcggccttggacgtgatggccgggttttggtcattgcgaccaaggtccttacatgcaggtttctgggctggcgagcgcgttatagttgagcgcgagcaggagcgtttagaagccggagcataagcgggcttgaccccaaatggcatgggcctggccatttggggtcaaggtccttatgtgcaggcttctgcgacggcgagcgcgttatagttgagcgcgttataacggacaccaaacaaggaggaactttttgatgaaaaaaatgtccagtggtgaaattcgccaaatgtttctggatttctttaagagcaagggccatgcagtcgaaccgagcgcatcacttattcccgttgatgatccaactctgctttggattaattccggcgtggcaaccctgaaaaaatattttgacggatcagtagtgcctgacaatccccggatcaccaatgcccaaaaatcaattcggacgaacgatattgaaaatgtcggcaaaactgctcgtcatttgacgttctttgaaatgcttggcaacttttctgttggcgactacttcaaaaaagaagtcattccttgggcgtgggaactgctcacgagtccaaaatggtttggatttgatcctaaacggttatacgtcaccgtctatccaaaagataaggtcacgaaagaactttggcagaaaactggggtgcctgacgatcatattgtggaggcggaagacaatttctgggatatcggtgaaggtccctctggtcccgattccgaaattttctatgatcgtggccaacaattcaataatgtggctgaggatgatccagaaaattatcctggtggcgaaaattcgcgttatgtcgaaatctggaacatcgtcttttctgagttgaatcatttgccagatggccgatttgtggaacaaccgcataagaacattgatactggcatgggtttggagcgactggtggcggttattcaaggcacacccacgatttttgaaaccgatttgttcatgccaatcatcaaagcaaccgagaaaatgagtgctggcaagcgctatggtgtcagtgcacaggatgatgtctcttttaaaatcattgccgaccatgcgcgaacagtgacctttgcgatcggcgatggcgccttaccaagcaatgaaggccgcggctatgttttacgtcgattaattcgtcgggcggttctgaatggtaaaaagctgggcattgatcatgattttctatatcaattagtgccggttgttggtgagatcatgaagagttattacccacagattctggccaaccagcagtttattcaaaaggtcattgaatctgaagaagcacgcttccgccagactttggacgccggcgtgaccttgctcaatcagatcattgctgacttgaaacaagacggtaagaaagaaattcctggagcagatgcgtttaaactctttgacacctatggcttcccagttgaaatgaccaacgaatatgcgcaagatgaaggtttgcaagtcgacatggctggcttcaagaaaaacatggctgcgcagcgtgatcgggctcgcaaagcgcgtggtgatcgacagtccatgggcagtcaagataaagtgctgatgagcatcactacgccaagcaaatttactggctggaccgaattggatcataagcacgcctccttgcagaccattgtggtgaatgatcaactgcaagatagtgtcagtgaaggcaccgcccaactgatttttgacgagaccccattctatgctgaaatgggtggccaagtggcggaccacggcgaaatcaaggcccaagacggcacggtgttagctgacgtgagcgatgtgcagcatgcgccaaatggccaaaatctgcacaccgttacggtgaagggcaaactggaaacaggccagcaatactggctaagtgttgatccgctacgccgtaagaaagtatcactcaatcacacggcaactcacttgctggatcaagctttgcgtgatgttctgggtgagcacacacatcaggctggctctttggttgaaccggattacttgcgcttcgactttacaaattttggtcaagtaacgcctaagcaactacgccaagttgaaacgattgtgaaccagaaaatttgggacgctttaccgattacttggaaagaaatgccaattgaagaggccaaaaaacttggtgcgattgcgatgtttggcgacaaatatggttctgtcgtgcggattgtcaagattggcgattacaacaccgaattcgatggcgggactcatccaaccaactccaatgcactcggcttattcaagattacaagtgagtctgggattggcgccgggattcgtcgggtcgaagcggtcacgtcaaaagaagcttacgaatatttgacccagcaacaggattggttgagcgaaactgctgagaatctaaagattgaccaagtcaaaaatgttccaagcaaagtgacccaattacaggcggatttaaaagccgaacaaaagacagtggctggcttacaggccaagttggcagcccaagcggcggcaggtatttttgatcatccggaggaagtcggcggtttgaaactgattgccaaacaggttcaggtggcaggaatgaatgaactccgacagttggcggataaatggaaagccaagcaggcatctgacattttggtactgggtaccgaagttagcggcaaggccaacttgttggttgctgtcaatgacacggctaaccaagcaggctttaaagcgggcgatttgatcaaggccattgcaccaaaagttggcggcggtggcggtggtcgtccagacatggcgcaggctggcggcaagaacccagctggcattcctgcggcgttgtctgaagcaaagacagtgattagccaaaaggcttagctgattaggccagatggtcaccatcgataatgaagcggcaagtttttggaaatttcgaaaacttgccgcttttacttgaccttttttctgagattggtgaagtcaatcacgcaaagttgagcggtcatgttaaacttaagaaaacgatttcatcgaggcggggagtatgaataggttgcggttgtcgttgactggcttttttggaccaaacgaacactatctggttgccgaacaacatggtggcattaaaatcatatattcagttgatccgcgtgtttcaacacctatttttttacggaccattgcacaaaatcaaataggccattaaattagtcgataacgacgattggtagccgcgcagaacaaaaatagcatttattcacttactattgctcaggaattgtacatttgcttgtatttcaagtaaaatggtctgtgaagcggatagaatagaggtgtaagaatgagcacattagatcaaaccgttcattttgattttcgagataacaatccgaagaatgttcacgaaacgctggagacagtttacaaggctcttgaagaaaaggggtataatccgatcaaccagattgtggggtatctgatttctggggacccggcctatattccacggtacaatgatgcgcgtaatctaatccggaaacatgagcgcgatgagatcattgaagagcttgttcgaaactatcttggcaaggagcaagcttaatgcgcttgatggggttggacgtcggttcccgaaccgttggggtcgcggtcagtgatcctttgggctggacagctcaaggtttggaaattattcggatcaacgaagacaaggagcagttcggcatcgcccgcctcaaggagcttgtgaagcaatatgaggtaacggcgtttgtattggggttgcctaaaaacatgaacaactcgattggaccgcgtgcggaaaagtcacaagcttacggtgaactgttgaaaacaacgtttgggttgccagttgatttcattgacgagcgactcacaacagttgaggcttcccgcatgttgattgaagaagctgatgccagtcgcaaacggcaaaagcaggtgatcgataaattagctgctcagatgattctccagaattatctggatgcaaaaggtcccttgaccaagcaataatcagggcaagtgatggcatgacctccgcccgtgttgaaggagaaacaagatggcaaataatgaacatgtaacgcccggcgaagacgatcagcagattacgctgattgacgaaaaaggcaatgaagaattgtatcaggtcttgttcacatttgattcggaagattatggcaagagttacgtattgctgtatccggcgagtgaaagtgacgatcaggaagtcgaaattcaggctttctcatttacccccgacgaaaatggtgatgccagctcgggcgatcttttcccgattgaagacgatgctgaatgggatatggttgaggaagttttgaacactttcttggccgacgacgattcgaatctgaaagattaagtcttaactcacggcatgtaagaccaccagaatattggtggtctttttgtagagtgcgagccagaccggttagaaaccggagtgtaagcggacctgaacgtgatggccgggctttggccattgcgctcagggtccttacacgcaggtttatgggctggcgagcgcgtttacgagcgaagcgtaaattgccagcagcctaaaaagggagttaaagccggcccggttttgaactggcgagcatatgaaccccacttaatattcgctggcaaaacagataaattgagctgtgtcgcaatcaaccccttaccctacttgccggctatggtagaatacactttgagagagtggaggcattcacgcaatgagcgaagaaaagcgtcgttttaaagccgtgatcggtgataaaacgtacacgattatcggaccagggtccgaacaacattttataacggtcacgaagttgctgaatgaacggctggcgcaagttaaaacacttgcgccagatctatcggccgaggaacaagccattttagttgccttcaattctgtttccgatcaggtcaaactgttggcggcgcaacaggatgatcatgagcaggaagagtagtgggggaccgtgttgatttcattatcgattattttaattttggcttatttctattatagcggcgcgcgtcgtggtgcggcgttgcagtggttgcatgtggccggttatgggttgagctttcttgctgcaactgcacttgctcggccactgggggcgcattttactttggtagtgccttacccgtctgctacgaatgccggtcagtttgcattttattcagataaagtcggcttgacgcttgataccgcattttatcgcggctttgcttttttagtcgtgctgacgtttggctggttattaactcgagtaggggcattgtggtttcacgacttgacatatgccgcaatgggtcatcgacgcagtgccattattggcggctgtgctaatttagtgattggttacatttttctgtttttgattttagccttgctggcattgattccgattgccggtattcaacatggcttagaccatgccatcgttgccaaggtcatgatcaaatattcgccagggctaacacaatttgtgaatgctttatggctatgaatgttgacgacgctcagggacgatttatcacgtctttgagcgcttcttggttataggagcaattatttatgaatgaaaagattttaaaaacccttgaatacgacaagattcagcaagcattgttgggtcaggtcgtgacagcaaatggccgccggctggtgcaggccatgcagccgctgaccgatccagtcgccgtacaacaggcactagatgaaaccgcagacggcgcatcggcgttgcgattaaaaggcggtattccggtgccgcaactcgagaatattgatccggcgcttaaacgagtcgacattggggccgttttgaatggtcaagaactagccagcatcagccgtgtcttgcaaacggtgagtgccattgataaatttttgactgatttacaggatcagattgattttcgccagctttacacacttcaagaatcgttaaccgtgttaccgcaattatcacggcgcttgaagacagccgttgatcctgatgggacattgaccgatgaggctagtcctcagctgcatggtgttcgtgaacagatcaaaagtattgaaggcgagatccgcggtaaaatgacaaattatactcgcggcgcccaatcaaagtatttaagtgacccgattgtgacgattcgggatgatcggtacgtgattccggttaaggctgagtatcgcgccaaatttggcggtgttgtccatgatcaaagtgcgaccggccaaaccttgtttattgaaccgcaagcaattgtcgccttgaataatcgactgcgtgaggcacaactggccgaggtagctgagattaaccgcatcttagccgaattgtctaatgaattagcgccttataccggtcaaatcaaggcgaatgcggcggttcttgggcattttgacttcatcaatgcgaaggcgagattagccaaggcggaaaaagcgacagagccgttagtgtcggctgataatgacgtattgttgcgtgatgctcggcaccccttgatcgatccgcataaggtggttggcaacgatattccgttgggcgacaagtaccaagctatggttatcaccggcccgaataccggtgggaaaacaatcaccctcaaaacattaggactgttgcagttgatggggcagtccggattgtttattccagctgatgatgaaagtcgtatcggcattttcgatgaagtctttgcggatattggcgatgaacaatccattgagcaaaatttgtcgactttttctgcacatatggacaatattgttcatattctcaaacaattgtcacagaatagtttagtgctgtttgatgaacttggcgccggcactgatccgcaagaaggtgcggcgctggcgatcgcgatcttggacgcagtgggtgaagttggcgcgtatgtggttgccacgacccattatccggaattgaagttgtatgggtacaatacagcaaagacgattaacgcatcgatggaatttgacagcaaaacgctgcagccgacttatcgccttttggtcggggtacctgggcgctcaaatgcgtttgatatttctgcacgtttggggctgccgagcgtgatcgttgagcgtgctaagtcaatgatcagctcggacagccatgagctgaataatatgatcagcgacttggagaaacagcgaaaggcagcggaaaccgcttatgaagccgctcgtcgtcagctagccgatgcacagtctgtccatgacgagctagcggcagcctacaagaagttcacaacggaacgcgatgcccagttgcagcaggctaaggacaaggccaacacgttggttgacaaggcccaaacgaaggcagataaaatcatcaagcaactgcgccaaatgcaattgacgaatccgggaaccgtgaaagagaatcaattgattgctgccaaaacggcgcttaaacaattgcatcaagacgagccgcttcagaaaaatcgcatcttgcgccgtgaacgtgagaaacaggcattgcatgttggtgatgaggtcaaagtggcaagttacgatcaaactggtaccttgctggagcaattcgataagaagcattggcaggttcaactaggcattttgaaaatgaaggtaccaactgatgagctggaaaaaatcaagccaagtaagcaatcagcggcgcaacgtccggttgtcaaagtaagtggcggcgggatgagcggcccatcgaccacgctggatttgcgcggcgagcggtatgatcaggcgatggcggatttggatcaatacattgatgccgccttattggccggttatccatctgtgacgattattcacggactgggcactggcgcgattcgcaacggggtgacccagtatcttaaacgcaatcggcaggttaaaacgtatggctttgcaccacaaaatgccggtggttcaggagctaccatcgtaaactttaagtagcaggtagttttttacacttcattgtgctatgatttagttacaaaaagtaagaggagggatccgttcatggttcaagcagtaacagattcaaactacaagacggagaccgacactggcgtcaccctaacagatttttgggcgacttggtgcggcccttgccggatgcagagtccggtcatcgacaaattggcagaaagtcgcgatgacgttaaattcgtgaaaatggacgtcgacgccaatccagagacaccaaagtcttttggcattatggccattccaaccttggtcatcaaaaaagatggcgaggttgttgagaagcttgttggctatcaaaccaaggatcagttggagtcaaccttgaacaaatatacggcttaatgaataagtgaacagacacgcatcgacgctactggtcgatgcgtgtttttttgcactaaaacatgttgaatgggatgtcacttaagatgaagctgacaggcgttaatttcaaaacttaaaatattgaagattttcttgatgctgatgaattggtctaaaaataactaggatatcaatagttatgttaaaatttttctaagtcattgtgtgggtatttgggacggtggcagcataattgttttacataccagtttcaaaaagggatagcttaggctccataacgcgttcgccaccgcagaaacctacgcataaggaccttggacgcaatggcccaagaccggccatcacgcccaaggccgcttatgcttcggtttctaaccgcggtggctcacgcttctcatattacgaaactgttagctcattgttacgcaattcgttggcgtcattttttctgaaaacctataatgaatgtgtaaataaaaacgtggggtggcatcatgttcgcaaaattaaaagctatgtgggagaatcccacttttcgatttattttttggaccattacgtattttcttatcctgttggtcttgatttatctctacggctacagcgggattaataacagtaaattcatttataacgagttctaaaagcgtgaactggcgcgactagaaaccggagcgccagtgaacgcgtctaaagaggaggagagccaatatgatcgataatgtgattactgcgatcgatcgggtcgccgcggaacatccaacgcgcgttgcttacgattatgaaggcacacagtacacttacgcacaattaaaagaaggtagcgatcgcttggcaggcttttttgctgaaaccttgcctgagcatgagccgatcattgtttacggcggtcagactttcgatatggtcgaggttttcttgggcctttccaagtctgggcatgcatacattccgattgatacccatagccccaatgagcggatcacgcaggtgcaggatgtcgcccatacaccggctatcatcgaagtagcgcctttgccgattgcggttccggatgttcagattattcgcgcaccagagttgcatgaagctgagaagacgcatgcacccattagttcattgcaacatgcggtcgttggcgatgacaattattatattattttcacaagcggcacaaccggcaaacctaaaggtgttcagatcagtcatgataacttgttgagttacgtgaactggaacatttccgattttggtctcaaggaaggcgttgtggccatgtcacagccaccctattcttttgacttgagtgtcatggatttgtacccgacattggttttgggcggtacgcttaaggcattgccaaaggaagtaacggacaatttcaaaacgttgttcgcaaccttacctaagctaggtttgaatgagtgggtatcaaccccgtcgtttgccgaaattgccttgcttgatcctaatttcaatcaagataattaccctgatttgacacatttcctgttctgtggtgaagaattggtcaataaaacggcgcaggagttgatcacccgttttccaaaggcaaccgtgtataacacatatggcccaaccgaaacgactgtggcggtcacaggaatggcaattacgcaggacattgtggatcaatatccgcgtttgccaattggttttgctaaaccggatacggaaattttcgttgtcgatgagcaaggcaatcaagtgtcagcgggtaccgaaggcgaattgatgattgttggaccaagtgtttcaaaggggtatcttaacaatcctgagaaaacggccaaagctttcttcaatgttggcagtcaacgcggctatcggtcaggcgatttagccacgatgactgaggatggcatgattttctatcgtggccgaactgactttcaggttaagctgcatggctatcgaatcgagcttgaagatgttgatcataacttgaatcaggtttcctacatcaaacaagcttcaacggtaccgcgctacaacaaggatcataaggttgctcaactgattgcttttgcagtggcgaagcccaatgacttcgaaagcgatatgaagctcactcaggcagtgaaagctgagctaggcaaaatggtgatggaatatatgatcccgcagcgcattatctatcgtgacaaattaccgctgacagccaacggcaaagtcgatcggaaagcgctgattgcagaggtaaatcattaatgctgaacttacaaccatatgagaatccgcaatactttgtttatctcatcattgctttactgccagttatcattggcatgttcaagggtttccggatgcactggtacgagagtcttttctcaatcgtttttctggtgatgatctttgatgccgataagtggccgcaaggtaaagcactgttgggatatgttgttttcaatctgctcttggtctatgcctacttcaagtatcgtacgcgagaaggatcaaaaaactcaacggcagtcttttatctcagcgtcattttgggcattgcccaattagtcgtagtcaaatttacaccgttgttccaacatcatgggtccattcttggatttttgggcatcagttatctgacatttcgggttgtcggtaccatcatggaaattcgggatgggtcaatcaaagatttgaacatgtggaaattcattcagtttctactgttcttcccaacaatttccagtggtccaattgaccggtatcgccggtttatcaaagactatgatcgtgtccctgatccagagcattatgcccagttagttactaaggcaatgcattatttgatgcttggatttttgtacaagttcattcttgggtacatttttggaactttatggctcccatcggttgaacatatggccatggtcagtcgtaccggcgcatttctaggcttaagctggccggtcgtaggtgtgatgtatgcttactccttctatctgttctttgactttgctggttatagtttattcgccgttgcgatctcgtatttgatggggatcgaaacgccaatgaacttcaataaaccgtggatgtcatacaacattaaggatttttggaatcgttggcatatgagcctaagtttctggttccgggattatatctacatgcgttttgtcttctttatgatgaagcataagttgattaaatcacggatctggacagcctttgtcggctatctggtgttgttcctgattatgggtatctggcatggggaaacttggtattacatcacgtatgggctattccatgcgatgttgatcaacttgacagacgcttggctgcggttcaagaagaagcacaaagacttcttcccgcacaacaaagcaacgcattactttgcgatcttcatgaccgctaatgctgtctgcttctcattcctgattttctcaggattcctagacacactctggttccattaaggtaacgttggtacaggcttgtcgctgtgacgacaagtcgcggattaaaaagaaagaggtacttaataatggctgacgaagcaattaaaaatggtgttttagatattttggcagatttaaccggttctgatgatgtgaagacaaatttggatctgaatctgtttgaaaccggcttgttagattcaatggggacggtacaactgttgttggaactgcaaagccagttcggcgtagaagcacctgtttctgaatttgatcgtagtcaatgggatacccctaacaaaatcatcgcaaaggtcgaacaagcacaatgaaaaaaccgatcgggaagatcctttggcgcggacttggcccgctgctgatcgctgtgatcctggtcgctgcgttgatgctcgtgccatttaagtttggccgcagcagccaagcaacgattagacaagcggccagctctatgtcggccaacgtgcttaaaggcgagaatatcaaaaatgaagccatggccgaaaactatgttccgtttatcgggtcatccgagctgtcgcggatggatgcctttcatccttctgtcctggcacaaaagtatcatcgcaactatcggccattcttgatggggatggctggcacgcaggatctcacgcacttcttgtcgatcaatgcgttacaacatgtgaatgggaaaaaggcagtcatggtgttgtcaccgcaatggttcgttcctggcggggttcgcaaggcgcagtttgattacttcttttcgcctgcacaaatgacaaccttcttgttatcagcgaatcctaactcagaggctgatcgttatgctgctagtcgattgttgcaatttccatccgctgactctgatcgcatcgccaatgatgctttgaagaatattgcggcagggcagaagttatctgacagtcagtactggtatttgaaaaaaatcaaggaacccatgtctgaccatcaggatattttattctctcagctgttcttggataataatcaacctaagttaaccaaagcagccaagacgctaccaggtacttacgatgctgatgtattggatggtctggcaacacaggatgggatgaaggaaacgacgaacaacgcgtttgagttgaaaaatgatttctacaccaaacgggttaagcgtaatttgcctaaattaaaaggctctcaggcaacatggagctatgtgaaatcacctgagtattcagatctacagttggtattgaacacgtatgcaaaaaagcacatggaggtactgttcgtcattccgccgatcaatgccaagtgggccgcttatactggtctggatctcgggatgattcaaaacacggttaccaagttaaagtatcaactgaagtcccaaggttttaatcacgttcttgatttgagtcaagatggtgctcagccatacttcatggaagacacgattcacattggctggcgtggctggctgaagatggatcaaactgtccggccatttctcaaaaccaccaaggctgcacccgtgcactacaagctgaatgatgacttttacacaacgcggtggcagcagcgtagtgctaatggcttgaactaaaacttgtcgagattcaaaaagcatcatactcaaaaaggagtctaaacgtaagcaactgcttgcgtttagactccttttgattgagcagtaagcatgcaaacccaaaaataggacagtcaattatgatacgagtcttttagcctattttttggttggttggtgatcagtttccaagttaatcagatgctcggctcgcggttgggtatcttgattatccatcacaacggtcagaacaacgttttgctcgcgacgttgaatcgcactgccgccttcgactgcaaaacctaaaacttgttgcagtgcttgcgccaagaaccctgcttctaattgaaaatcaggatcttcatatgtacgaattcgcgttgccacaacgtcaccagcgagtaaatattgccgttcctgccgcttttgtttgagcggggtgagcgcgccaaagccaacctgcgtgaacagttgcggaatggctgtctcatcgacaggcaacttagcagccaaatcgcgcccagcccaataaaggatgttgtgctgttcctcgccaagcatattcggcagcatgagatcacgcattgctgtcaacgcaaagaacgaaaccgagcctggaaggttcagcagggtggtatagtcagattttgccatgttgtgcctcctgtttctattcgtctagtatagcggaaaatccaaagcaaagcatgattttctcaacgcttgcaatttttaacaagaaaactcacaataaagtttcagagagcgtgagcaggcgcggttagaaaccggagcataagcggccttgaagctaaatggctgggctttggccatttagcttcaaggtccttatgtgcaggtttctgcgcctgcgaacgcgttttagcggatccgagggccattttgcgaccaaggtccttacacgcaaactctcgggcctagaaatgcggctaaaaacgatctgtctcacacttctacagcttcacccaaagcccgtgaggcagaacattttaaaaagaatcctatgcagacattttggcaacatgaactactttgcttgccatccctgcaaacctgtttcaaaaggagaatatttcatgaacaagcaaccaatcggctttattgattctggtgtcggcgggctgacagtcgttaaagaggcgttgcatcagctgccagctgaaagcagtgtttatctgggcgatcaggctcgtttgccatatggcccgcgacctgccgaacaagtacaggcgtttacttggcagatggtcaatttcttgcttaaaaagcatattaaaatgctcgtcattgcctgcaacactgccaccgcagcggcattacccttaattaaggctaacttagacataccagtcatcggggtgatcaaacccggcagtcgagcggcactgaaggcgacgcaaactggtcacatcgggattatcgccacagaaggcaccgttaaaagcggtgcttatgtgaaggctttacgcgcaaaggcgccgaagattcgcctaactagtctggcggcccctaaatttgtctcattggtggaaagtaacgaagcccactcacccattgctaaacgggtggtggctaacaccttgcaaccattgctgcatgaagacattgacacgttaattttaggttgtacacattacccgattctgcgcccgttgattcaaaatgtgatgggtgatcaagtgaccttaattgattccggcgccgagactgtgaatgatgtttccatgctacttgattattttgatctagcaaacaacagcggcgacaccccaactcacgaatattacacaaccggggcaccatcaatgtttgacgaacttggcgaagcttggcttgaactgacggcgccgatgcacgccaaacatgtcaacattgaggctgaggcagaccacgctatggctacagtgcctgaagcaaagggtaaaacgattgtcgttgccagcaaaaatcaaggaaagattaaagaatttaaaacaatgtttgaacctgctggcatcacggtgaagagtctagccgacttttcaagcgtgccaacagttgacgaaactggcacaacatttgaggagaacgcccgacaaaaagccgatcagtatgccaaagatttgcagttgccggtgattgcagatgattctgggttgatggtcgatgctttagacgggcaacctggtattcgctcagcccgttatgcaggcgatggtcacaacgatgcagctaacaatgccaaactattggcagccttggcagatgtcccggaagatgatcgaacagcgacttttcatactaccttggtgcttgctaaaccggatcatccggaagcagacttggtggtacatggtgatgtgagcggactaatcactgcgatcccacgtggcacagatggttttggctatgatccattcttttttgttccagcgttagggaagacaatggcggaaatgaccgctgaagaaaaaaatcaaattagtcatcgcgggaacgcaatgagggcacttgaagatgtttggcaaacatggttggaggcaaacggatgaaaattttagcagttagcgatacccacggtgatcgagagattctcacagctttgttgaaacaacagccgcatcttgatggttatttctatgccggtgactcagaattagccgctgatgatggcctttttcagcagtacgaggcagttgaaggcaacatggactatgatcctaattttcccatgcaaatcacgaccaccattcaaggtgtgacagtcttcatggcccatggacatcgttttggggttaattttggcctagataaactcatcgctgcgggcgaaggggttcatgctgatctgatcattttcgggcatacccatcagttaggtgtggaggaacatgcggggattgtgattcttaatcctggttctatcagccagccgcgtggccagtttgccaaccttggcggaacttatgccactgttgaatttactgtggataacgttcatgttgattttttgaagcgtgatggggcaatcgtgccagaattaagtcgtgatttttcaaggaagcacgattaaaaaaagatctcactagcaggacgctgtcaattgacagtgatctgcaggtgagatctttttggctagcctttgatgaatagaactttgtaggtgaagacggctaggatggctgctaaaatcggagcaacaaccggtacccatgagtatccccagtcggagctacctttatgtttaagcggcagcagtgcatggagaatgcggggaccgaggtcacgggccgggttcaaggctggcccagttggtccacctagcgaggcaaccaaggtcgcgaccagaaaacccagtcccatgtgggcagtacccagattattttgaaaaaaaggagccttggtaattccgagggcaccgataaaaagaatataggacccgatgaactcgttgacgaaaccgttaagcctgctcttggtggcgctgatcgtgctgaaggtgcctaaaacatgctgtgtattggttgtgagatcataatgcggtttgtaggccgcaaccaccaataactgaccgaacatggcaccagccatctgtaccgcaatatatggcaagacttctgaccatgggaacatgccagatgcagcgagtccaagggtaaaggcgggattgatgtgattgcctgaaatcgcgccaaacatcatcgcaggaatcatcaccccagcaccgtagcccacggcaatgagcaaccagtcagagccgttaccttttgtcccttttaaatcaacgttggctacagagccatttcccagtagcaccataatcgcggtgccaataaattcggcggctaaacgcacgcctagatcgtatgtcatttgtttcctccaagtagttaaaataatacccaaaagcttatgaaagtataaatatagctgaaaatagtgtaccaactttttggggaaccgtccatttaaacgactagtaagcgtgggcaggtttctgtgcctgcgaatgcgctgctttacgcattatcggacgaattcgctcgaaaggtggttgaatcaattaaccaattgtccgtcttttgacggatggcagcgagtaacgtaagcgttaagatgaaataaagaagttgcctgaagctgaatttttaggcgtactcaggtaaaataggactgtcaataaaggagttgctcatatgttaaatccagtcattgccaatatgctgatcgaaaatcggcatcacttcatgatttcagccgacatggttgcaactgtgtctgaaaacaatcctttgagtcatgcctttttggtattgaccaaggtgcggtatgcgaaaattcccgtcctcgatcatgattcaaaattcaaagggctcatctcactgccaatgattaccgagaccatgcttggccttgatcacatgagttttaattcactagatacaatgacagtcaaagatgtgatgcagacagaggtcgcgaccattgatgatccctacgacttggaaaatgtcctacatttgctcgtcgacaacccattcattccggttgttcaagatggttactttactggcatcgtcacccgtcgtgaagttatgaaggggatcaataatattggtcacaacatagataagaattttcaattagaacccttaacagttacggtacctaaagaatcttaacttagaaaaaacgtcgcattgctaaaagcagggcgacgcttttttatatcagcgagcacattcagtgacagtcgtgatgccaaacttattttttctcgtcagcatctggtttgtctaagaaaatggtggcgagcacgccgatgacgaggctaatgacaaccatggcgatggcgccgaggtgaccagtggctggccaataaggggcgataccagcctcgataagaatcacgactgctgccaagacaatgccgcaaacggcgtagtagacttgtgcttcaaaatgggccaataagtaggccatcaatttagctactgctatcagacctgctgcagccccaatcatgaacgggagcaacaaggcaactgatcccatcgccgtatgaaaagcggcccaattgccggatgcggcagcacgagccgcatcacctaactgacccacagcattgtaaaccgtaccgtattgatcaatcaccatcaacatgactgaaccagaaataccgggaattgccatcaatgaaactgcaaaaacgccggcaaaggccatgacgccagcatcactaacacttgtcaaacgtttaatggcaatcagattctcagggtcagtaccaccaagcttagccagcccgtatatggcaacgaagccaaagaccactagtagtaagtaccaccatgaaaactttttggttgtcagtttacggtaaatgaacggaccgatacccagcactaaaccaataaagaagccatagcttggcagcggccagcgggtggtgacgaccagaaccgccttagtggaaagcaggatgccgatcacagcacccaacccgatcggtgtcaaaaaccgcatattttttttgggatcatcgcgaaaatggttgaccgcatttaacaatcggtcatagaggccgacgaccacagcaaaaatactgccagaaagtcctggaatgacaagtgcgatgccaataatggcacctttaacgaaatttagcataacatctccttttgaattgggttaagccgcttgatgataacgtgacaatggcacggtggttcatgaaccactttgcaagtttaacggcggtgtgacaacttttatgcctgcagaattcaaggcagcaacgtaggcgcctaagaaagtgcgttgcaggctcacttgttcgccattttcggcgtaaaaaagaacctgataggtgaaagcaccattcttttcttcagttagcccaagaatgtcaggctcctcggtaatggttgtaaatttcggtaccaaatcttgattcacacgttcaatggttttccgaactagatcgagatcagcacttggggcaagcggcaatttaatcagcacctgcatattgcttcgcgaaaggttgctgacgatggtgatgttgcgattgggaatgaaattgacagtcccatcggaactcttcaccaccgtcgtccgcaaaccgacattggtcacggtaccagagatggtgccgagtttgacgacatccccgacatcaaattgtgcttctaaaaggatgaagaagccggtcacgacgtcgtttacaaatccctgtgccccaaaaccaactgccaaacccacaactccagcaccggctaacagtgtccccactggtacgccgagaatcgataagatggcgtaaaggtagaagaagagcaccagatagaaaaaaacattcaccgataacgcatgaattgttttgacccgggtgcctgtcagatgtgcccgtcgttgatagcttttaaaggtgcgattgagcgcaaagcggccgagccggtacagaattaaaaataagacggtgaaaaacagcaacgacagcactttgtcgataaaagtgcctacgattttatcccaatcgatggttgtaaaatatttcagccaaacgttggtttgctcgttgacggttgttgctgtgacgatcatgtgtatcacgtgactgcctcctttacattggcactattttaccagaatcggtgggtgtgtgctgggagatttggtttgagtgggcggtaagattctccgaaacgcgcaaaccggcgcagaaactttcacgtaaggatcttggatgcaatgaccccaaaccggtcatcacgcccaaggccacttacgttccagtttctaagcgcgccggtttgcggtcttaatttttttgcaccgttcttgtcacgatgttatgattgttttaatcaactggtttgaaataggagggtgttggatgtcaggtggagagattgcttggattatcgcggctgttgcgtttctgattattgcacttgcaattgcgattattgcggttcgtgtttctggtgtgacgaaagaagttaagggcacggttgccgagacgaataagacgttgaacacgatcaacggagagcttggcattttgacgaaggaagttgaaggtcttttggctaagagcaacaccctgcttgaggacgtgaacggtaaggtggcggcaattgaccccgtctttactgcgatcggcgaacttggtgagagtgtctccgatttgaatcaatcaacgcgcaatttaactgagcgtgttgcgcatggtgccaagaacggagccaaggcgaccgttgcggctcgtatgagtgccaaggcgttttcaatgttgacgaagaaaaaacataacgatcaatagcagggggaagaatcatggctaaaaaaggacattttttgcttggatttgtattcggtgccgctagtgccttagccaccacttatttattaacaccacaaacaagcgatgaattgaagcggcgtgtgaagcatgcttctgaagacttggcagatcgggcagttgattatttcgattatgccaaggaagctagcgctgactggaaacaaagtgccacagattttgttgatgaattgaagcgtaaaggcgacgatgctgatggttctaaagcattggcaaactatgatgctgccaccgagcaattgcgtgatcaactgaatacggcaacagatacggactcatcagcagactttgatgacattgttcttgacggtaaaagtgcttttgcgcaagctaaagatgacgacgagggcagtgatacccgcaccgatgaagtgccagaaccagtagaaccagaagcagttgcaccagcgtcaactgataccgcaccggctagcagtgttgcacctgatgaaccgcaagcatctgcaacaaatgataagtaacagacatgcatcacttagtcacaattgatgcaaaaaaggcgacaaacggattgttcctatgattggagcaagacgtttgtcgcttttcgcatcagttattgtcaatttgccataatcggtggtacttcatagatcaggcaggttggggccttttgcagcaaccaaacgacgacttggttgccaaggtcgcagcaccgtctatagatcttttttaaaggagagaatatgctgaacagtgaacgtcaagcgcagatcaaggctgctttaagtacagccgctgagccgcttagtgcctcaagttttgcccggcagtttgccgtgagccgccagacaattgttggcgacattgcgttgttgcgcgcacaaggtgagccgattattgcaacgccacgagggtatatgttttctcgaccggccgcccatgagtttttgttgccttgcaaacatacgccagcacaaactgccgaagagttacagttgattcttgaaaatggcggatggatcgaggatgttttggttgagcatccgctttatggacaattgcgcggccagttaaacatccggacagtggctgacatgaaactgtttatgagtcggttgtcgcgctatcatggccgactgttgtcagaattgaccggcggcattcatttgcacacgattagcgttaaaaatgagcgcgatatgcccaaaatcaaagcagctttgcggcaggcggggatgctatatgaacaagtggagcagaggtagtctgatgccgctaaaaaagccgtccggaatctttccgggcagctttttttgtggcatatgaatacgactatattgcagttttttagacctgtcctagccgttaatgaccgtgaattcctttgaggtgtgggtaaatggttcgcagccggtttcggtgacgtggacacagtcctcaatccgaacgccagcaacaccaggtacatagatgcccggttcgattgagaaacacattcctggctgcaacagcatatcgtttccttccatgattgatggaaattcatgtgtcgacatgccaatcccatgaccaagccgatggttaaagtaatcgccataaccagccttagtaatgatgtcgcgggcaatcttatcgagctcggatgctttcaaaccaggcttgacagccgccattgcggttaaattggcctctaaacagacatcgaaaatttcccgcggcttgccggtgacctgaccaaatgcaacagtacgggtggcatctgacatatagccatggttgtcagtcccaaggtcgaacaaaaccaactcgtttggttgaagcttggtgcccattggttcaccatgcggattggcagcgtcgacgccggcctgcacaatggtaccaaagctcatgtgcatgacgccttccttcatcatggcataatcgatttcagctgccacttcttgttctgtcgcgccagctttgatcgcgttaaagccggcctgaaaggcgcgatctgcctgggcaccagctgcttccatctgtttgatttctgccggtgtcttaatgagtcgctggttctcaatgaaccgggatgcgtcaaccggaaaggtagcatccggaaattgtttcatgagagcttcaaatttgaagacagctagattatctttttcaattgcccattttgtcgggttcgctgtcaccgctttgatgtgattagccatgatggcaaatggatcttcgtgatcaagataaccgaagacttggtacggccagccagcttttttgacctcttcaatcgtcagctgaggggtgaagaggaaaggatcgttgtcaggggtgacaatcaacgctgtgatgcgttcctcaggatcttgaaaaaagcctgtgtagtagttgatattgattgggtcgctaatataggccaggtccaacccttcttttgcaacccaagcttgcaaagcggctaaatgttcattcatattttttcctcctcaacgtgttcactggcgcagtaccatgcaggtgcggtgcactttttaaccggactagctcgcgatctggcttaaaagtcatgcgccaatcaagcatcgtggtaaaatagcacaacttaaaactttaacttttagtatatcacgtgactagcttgatgggctttctgaaaaaggcggttgtgaaaatttcatgtaaaattcagtaaaacgcttgcattgctatttctattctgttactttggaatgtaaatagaacttcgtgatttcatcttttcacgactaaggagaaaatcaattggaaaagcaaacaattacaatttatgatgtcgcacgcgaggcgaatgtctcaatggcgacagtgtctcgagtcgttaatggtaacccaaatgtgaaaccagctactcgcaagaaggttttggaagtgatcgaacggcttgattatcggccgaatgcagttgctcgtggtctggcaagcaagaagacgacaactgtcggggtaattatcccagatgtcacgaacatgttcttctcaagcttggcacgtgggattgatgatgttgccacgatgtacaagtacaatatcatcttggcgaactctgatgaaaacaatcaaaaagaagtcacggtgttaaacacattgttggctaaacaagtggatggtttgattttcatgggccatgaattgactgactcaattcgtgctgaattctcacgcagtaagacccctgttgtgcttgctggctcaatcgatcctgacgaacaggttggcagtgtcaacatcgattacgtggctgctgtcgaagaagccacgcgtcagttattggaaagcggcaacaagcgggttgctctggcgaccggttcattgacgcatccgatcaatgggcagttccggctcaagggttacaaacaggctctggaaaaggccggtgttgcttatgacgaaagcctgatttttgaaaatgagccaagctaccaagctggtttagccttgtttgataagttgcagaaagttggggcaacggcggttattgcaggtgatgacgagttagcagttggccttttggatggcgcaattgataagggcgttaaggtgccggacgactttgaaattatcaccagcaataacaccaaactgacggaaatgactcggccacaacttacttcgattgatcagccattgtatgatattggtgcggttgctatgcgcttgctgaccaagatgatgaataaagaagagatcgaggaaaagaccgttatgcttggcttcgatattttgaagcgtggttcaacgaaataaagccagcttttgtgagctgcttagcagacatgtaaagtcattagggtaaagaaaaaggcttccaagcaaattacttggaggccttttttctttgcgttgaaatgaaaactcgtgatcgtgttgttactgaccgccgccagtcgttgttgcaggtggggtctgttgttgattggtattattagtgccaccagtattcgtaccgccaccagtcgttgtacctgtgccggttgtcgtgccagtttctgtggtcgtcccagtaccgccagtcccaccagtgccggtggcgccattcgtgccgccagtccctgtggtttgtggttcgcttggctggttttcagatgtcccttgttggttttgctgacttgatggcactgtcacgctaggagcactgctaggtgtcgtctgagtatcttcagttggcgtgatcggggtttcttgatgttcttttttggcttcagttgaattgccgttggcatcggaaacctgaccatagccattttgtttgccatcaagatggtcgaagaacaactgataattagctttactgccaccgatggcaaaatcatttttcgtggttggctgccaatcattgtaaaggctggtgacggttgagccgccagttcggtaggtgtttccgtcaaaagtcaaggtgccggcgggttgcccagtttgtttatcgacagtcactgatttaaccgtatccgggcgtgccagtttctgattaaccttaaattgtttaggaatcgtctggtaaactgcgttggttaatttagcccaataggcttcattggtcatggagccagtctcatctagtgaataagttgtgccatcattattgtcatagcccatccaactggcgattgttaccccaggtgtcgagccaataaaccagatgtcccggaaatcattgctcgtccctgttttcccgatcaggttatcagtgttgaagtggagttgataattgaggctttccgcagttccggaatcaatcacgtttttcaacatttgattcatgatgtaggtcgtgcccttagagaagactttagttttcttaaccttatgttgatagattggatgaccagacggatcgacaatctccgaaatcacgtaggctggtacgtgctcaccttggttggcaaaggttgaaaatgcgctggcttgttctttgacatcaaccccgtaatcagtcccgcccaaagcgagtccaagctgactatagtcatttttggtgagggtatcgatgcccattttatccatatagtccttaacattaacagtcggcttgatgtgtttatataagttgactgctgggatgttgtatgattgggcaagcgcttcggtggcaggaataaagcgattctgaatctgaccgccgtagtctgtcacgctgtaattgttgccgagatcggttttaaaatcagccaacgctgtttgcgagccgatgattttttggtcaacggccggcgcgtaaactagcaaaggcttaatcgttgatcctggcgaacgtaatgtatagatgtgattgagttcaccagagactccgccaacgaagcctaaaacagccccagtttgattgtccaagacgaccgaaccattttggactggatgtttaatggtttcggtttcgccagtcttcggattaatttgtgtgctggtataagtctgaccaaatgtgctgcgtgttgccttcatcacaaattgcatccggtcgtaaacatctttgttaatcgtgcttttaatctgataatttttcgatgaaaaaagattagcagcttgccgcagatagtcgttgtttaaggcgttgtctttcgccaattcggcggcggaatggccatcgtttttagccaactgctcagcaagtaatgattcggcttcgcttaataccatgttgtacacgtagccatattgattgtcgtcttcttcagcattctcatgctggagaaaagcacctttgatatcaaatgccttggcgtcgacatattgtttatgactaatgaccccagctcgatacatccggaatagaacggtctgctgacgatccacaccatctttgagattgcttttaagggcgccagaagcggtatacggggtgtaaataaacggactttgtggcaggccggcaataaacgctgcttctggcaggttgatgtccttcgccgagacgccgaataggccttgggcagctgcctcaaccccagctatgttttgacctttattgttacgaccaagtgtggccacattcaaatacgtggctagaatttgatccttgctaaaatgattatttaaacgtcgggccagcataatttctgccgctttacgtttaaaggtcgtttctgagcttagaaacatcattttgaccacttgttgtgtcaatgttgagccaccggtttgattgcccatgccagttaaatcagagaaaaaagcacgaatgaccgctttgggtacaacgccatcatgccgatagaagtcttcatcttcagtggcgacaatggcttttgtcagccaaggcgacatttcattcaaatcaaccttggttgagaccaaatcgcttttaacattgctgagtttgacgttgtgagcaaaatacatgctggaagtgcggcttgtattggaaagggtggccttcatggcagcttcggtcggaatcggggtggcatcgataattgaaacgaaatagccgccgaataaaccgaggccaaagacagtcgcaataccgagcacgccgagtaagtaataaacaatggttttaatactttgtaaggtgacgttgccgtaaaagacaacggcctccttgccagttaagtttgttgtctctgcttcggaatcaggacgccgggtcacaaacgcagtgaaccagtggcgaaatcgagtcccgagcgttttgactcgatcaaagaacttcttcaaatgcttgtcccaccttaaattatggtctagtacgccttagtataccttaaatattaagcggattctaaccggggatttgttgaggcgtgtgaaccgacctagcctaaaaccggggtgtaagctgcttaaggcgtgatgaccggtttttggcggggtcgttgtctgcagattccaaggctagtgagcacatctttgacgcagtggcgaagcttaagcgctgacttcgcaaacagcttgtcacgtctcatcaggtgtgtaaaactgatagcatgtagctttaagacgagaataggagcttagtatgtatcggataattttgtttgatgttgatgacacgttactggattttaaagcaggtgaactaaaaagtctggcaaagatgtttgccagactcaatttgacttactcgccgcggattgaggcaagttatctgaaaattaatgccagtctatggcgtgactacgaagcggggcgcatcacgcggccggaattgtttgatgtgcggtttgccaaactctttcgccatcatcacattgaggctgatccgcatttggcagaacgcacctatcatcattttttggatcaagaggccattttgctgccgcgagttctggacaccttggatgcgttgcaggattatcggctgtttattgtcagcaacggtatcgagcctgtgcaacgtgaacgcttggcatcgagcggtctgattgattactttgaagatatttttgtttctgatatcgtgggcagcccgaagccgaccgtggccttttttgactatgttgccaaacgcatcccgcggtttgaccggcgtgagacattgatcatgggcgactcgctgacctcagacattcaaggtgggatcaatggcaaaattgattcgatttggtttaatccacattttcagccaaatcgcgatcacatcacaccgacttatcaactcaacgaatttagcgatttgacgaagctattggcgcttaactgaagtgacttagactgtttcaacgagtcggatggtgccgcttgagaccaccaatgtaccaagatctgtttttaatagtaaagcgccgttatcatcgaatccgctgatcgtcccggtcagcggattttgtgtgccgctgaccgtgatgcggcgaccaacccacgctgctcgtttgcggtacgctggcatgatggtctcgggattggcaaaaagccgcatcaagtgggtcaaataacgaccagcaagctcgggacgcggatcatttgcagggacctcgcgcaaaatggttgtcatcggctgatcatttggcaaaggaccgctggcagcagggaaaagatcgacgccggttcccaaaatgacagcattttgttccaacaacgcttcggctaaaatacccgcgactttcttaccagctttctgtagatcgtttacccacttaatctgagtgctgatgccaaactgatcggcgattgcttgttgaagcgcaacaccagcagcaggtgtgattagggcgcggttaatttgtggatgaaacgcatagctgatgtaaagtccagcatcagctgggcttgcaaaatgtttaccatgtcgtccaacgccagcggtttgctggtcggcaattaaaatctgtggcaaagggccgccgttttgaacggacttttttaaaatgacatttgtggatgtgacggtgcctgctgtggtgacagcggcacgcaaacggggatcatctaaccatgggtttaaagcatcaggttcaaacataaattgcttcctttcagacgttttgataacggttaacgccaacaaggccgacctagtttaaaactaagacggccttgcatgaactgaatgtcgataaaatgacgcccagagattacttgaccaggcgactgatggcatcggcataaatggcaacagccgtgatgatatccttaatcggcatgtattcgttagcttgatgcatcacattttcttgacctggcatttgggcaccgaatgcaacgccgcgcttaatgatacgaccataagttccgcctccgatcacttgctcatgtcctgggatcccggtgtgatcagtgaatgtttggagaagtgttttcaccaatggatcatcccctggcacatagtgagggccttgggcatgaccactgatgcttacggtgaccttgtcggcgcctaatgtcgtctcaatctgatcacgaatggtgtcagcatctgtcccttgcggataacggacattcacaagcacactttgttcgccatcttgagtaaaggtgaagatgtctgggctggcggtcaattcgcccatcagcttgtcggtataattgatgcctaacagcttgcctcgtgagtcgttgtgcaagtatttagcgaccatcaggagataagctttaccggctggatcaaatggcaagtctgccagtagattggccaagtaagtgccagcatttttgccatcttttggctcctgtgcatgtgcacctttgccgacaacttcaatggttgttggattacccaaagtaagggtaagtttgacgccagcctcatccgcccaagcggttgcttgtgtggcaaaagtttctggtaaatcgccggtgatggtcgcagttgcgacttgcggcaccatgtttggccgaatcccggccgagaagttggtgagcgttaactcagctggtgcagcggcaattggcttttgatcgattttgaaactggcaatgcctttttcaccgttgatgattggaaattcagcatctggtgagaagccaaaatccggtgccggctgggtttccagatagcgatgaatcccgacccattcggattcttcatcggtgccgatgataaagtggatctttttattgattggcaggccaagatcacgaatcaactttaaggcataataagctgcgatgcttggtcctttatcatcgctagtgccacgcccataaattttaccgtccttgataacgggcacgaatggatcagtttgccaacctggacctgctggcacaacatccacatggccaaacaaaccaaagatctcgtcaccgctgccaagctcaatgcgaccggcaacgttatcaacattaagtgttttgaaaccatcgcgttcggcaatggtcaaaaaggcttccagtgctttggccggtcccgggccaagtgggtacgcctttgtttgatggtccgtatcgcgctcagagttgattttcaaaagggttgtcaagtctgaaaggagttgcggttctaacttctctgcttcttgctgccaattaatcgtcatgaggttaacctactttcttactgtcattgtctttaggatagcatgtttaatcatgggaaactaataagccgttcatcaaattgtgagggttgatagtcacaattgatgaacggcttatgattgagcgtggttcggcgattaaccgatgccaacgacgctagcattcaacagtggtgtgtcaaaggccgtgtcgcctaatgcccagtggacaagtggcttttgtgcagcaggaatactgcgatattgactcatccaggtagtcatattttcagcatctggcaacagttgcaaatcttgggcgtttagccaaccggttttgatctttacatagaggtgattgccttcataccgtgccgctgtgatgtgatggcgcgtatggttagcgatgtgagcaatgacatcttgttgatgcaacggatcagcgtatactggcacgcgaaatttttttccggtgacaacaacattttgattaatgaagaggctagcccatccggcttgcggcgcaagattgacagttgtcgctggaacgaaagcattgtcgccaatttgataataggtgttgccagcaatcgtgaccatgctggaaatcatcacaggggtttcaggcgctaattgttcatggcgcaacgtcggctgatatggattttcgtaaatgggtaagggcgtggtactggagttggcgccaagatcgttaatatcggttgtcactgcagcggccttcaatgcctgaaattcatgccctagagccgtatagttggtgacgataccgtcaatgttgagattcaccagccaagtccataatgagcgattttcgttcatctcgtcccagatgtagacttttttgccaagatcgtgaagttgggtcacaagttgcggtgtcactaagtccgaactcaggttgataccatctacgtaggttaagacatcaaaattgattcgtttaagtgagccaacaataaggatacggggcacattgggcaaaacggcttgaagcctttttaagcttgcagcggaaaatgagtgaaacatcacacgattttccatgtgatacttttggattaatgccgctattttgtcttcgagatggggatgaggttctccctttacgattttggtctcaattagaaatttatggttggtttgttgctcatgaatgaagagatcttccaagctgtgaatcggctcgccatttttggtatgatattgctgaagctgagcaaagttcgttgtggcaattgccaaattagcgccggtcattcgttgaatcgttgagtcgtgttgaatcaccacgacaccgtcagcactttcatgtacatccagttcgacatagtcggcgccattattaaaagcactgtcaaaactttggtaagtctcttccggataattcaacggatcgccgcgatggccgatcagcgtgaaacccgaaagcagaaggaataaaggcagcaatagcactgccagcgtgagtcgcttgcccatacaggctgctcctttccagaaaaaaacatcataccataaacatagcaccgcaaagtagccgggacaatttttagaacacgacatgcagtggctaaattgataaaggagtatgaagaacatggctgataaatttcaagttttcgatttaattcaagaaatcacacggaatgacggtagtcgctattttgaactaggtaacgtcatgatgaacggtcgggcagaaaaggcggctatgaagggacttattaaacgtgtgcggatcgttcaactaaacattccccattcaactgctgtgacagcttacgaacagtacatcaacgatcattatgaattcccgtcagctgatttgacgagctgggaagagtgggacaaaccagaagggccagtacgtcaggcttaccacgagattctaaagcagaaccatgttggatgagtggtgatatcgctggatcgtcagcgacagtaacaatttaaacaaaacctaacaaacactggcattcacactggtaacgttggcttgggtgatgctagcagcggtgcggtggctttagtctcacccactgcgctaactaggtgagcaccatcgcgaatcgtcaggtagttggcttgattttcggttagtttgatacacgccgcattttgcgtcacgttgacgccacttatataatgtagggcatatgaaagtagggcattcactaggcaaattttggccgggtgaatgtgaggaggcgtcagcgtgaagtattttggtagatggcttattccgttcgttgcggcaattgcggtttttattggcatgcagtttgatagcagtctttacaccaaaccagtcggtcgtgtcgaatcagttcaagtcattaaaacgaccagtcatgatgatgaggatcagaatcatgatcggctaaccaagcaacaggttaaagtgcgtttactgaacacagcaaaacgcgggcaaagcgtcaccattcataatacgtactcgttcagcggcggtttagacaatcagttgcggccaggtgaacaaatctttttagatgtcgataagggcgtctatacgctcaacaacatcaaacgcgatgccatccttgcggcgttgcttgttttgacatttggcctaatttttttggttatggggcgtcgcgcttggttaacaagtattagtattcttttgaacacagtgatcttttttatcgcggtaacgtgggaaattggcagtaagcaatggcaggcgtggtggttgtttgttggtctagcagtcgtatttacaattctgactgcggttttcattgttggttttaagccgattgccgtcacaatttcactgggatcgttactggcaactggccttgctgtggcgctaggctatggtgtactgacgttgacaaattataacggtgtgcatctggaagaagtgaaatatgcgacgcaaatgccgcaattgctgttcttcgctcagattgttattggttcattaggcgctgttcttgatgaagcgagtgacatttcagtggcaatttttcagttgcatgacagcgccaaagaacggtttcaggcaggtatggcaatcggccggaatgtcatgggaccgctaatttcagtgctctttatgatctttattgctgatacttttgtggaatcagtgctatggattcgtaataataactcgattgcacaaacagtcatttgggtgatggggcttggttttgcccaaagtttaattagtgccttcggaattgtcctagcggtgccaatgacgagcggtttagccgcgtttatggctaaaataaagaaggtggcagcatgaatgcaattcttgccttggcactattgctactagtcatgatgctcttgattgggggcaaacaaggcctagccaatttctttgcgctgacggtcaatgctttgcttatgattttagtcgtgatcttgatggcgagtgggttcaatccaattattctcgctgtggtattcggattgattattttagccagcaccattttcttgagcacgagtcatgtagcggttgcgggtccagcgtttgtttccgcgttgctaatcatgacgttgcttgtggggctcattattttgactatgacgctcagtcagacagctggctttggaccagaagattcagaaagtcttgaaggcttctctgtttacatcggggttagttttccgcatattttgattgcaacaaccttattaggcacgctgggagccatcgcggaggcggccattgccgtagcggcggggatggatgaaatcaaggatcaagcaagtgatgccggcatcaagcagatggggcatgagattattggcacggcgttaaatacattgttctttggattttttggcgggttttcatcattgttcatttggtttgcatctttgcgctatccgttcagccaaatcatcaataataaaatctttgttggggagttgttgcaagtcttgatttcggtcattgccgttgttttgacggtaccgatgacaacttgggttgtgacaactcgtcatgcgcatcgcagaaaggaataatatgcagtatttcattgcagacactcatttttttcacgccgatctattaggccaaaacgattttgcaccgcgacttttcccctctgttgaggctatggacacggcaatgatcaatgcttggaatgctcgcgtgggggatcgggatattgtctatcatttaggcgatatcgcgatgaatcctgagcattttccgcaaccaccagaagtgcttggtatattaaaacagctgaacggtcgaattgtcttcattaaagggaaccatgattatgagtcactgttcaagtttcttcatcgaaatgatcctggtgtgaatggacagccaaaattcacgtttcatgatgttggcaccattattaaggacgaccatacacaattcattatgacgcactacccgttgatgatggggattgtcaaacaaacactgaatttacatggtcatattcatcacaacagcgtcaatctcgcggagaatattaatgtcggggtagatgcaccggaacgcgatttgttgatgccacacctgccatttgggacaccgctgtccgctgctgaagtgcatgaaatttatcggcttaaggcccaggcgttagcccaaaatcgatgaacaaccgtttgtttgaccgcccgcttatcagagcataggataaaaataagaaagcgcgccggtgattcaccagttagagtatttatttttgccggcacagggaggtttctcgtggaaaagttagtgatcctgcataccaatgatctgcattctcattttgaaaattggccgaagattcggcggtttatgttgggaacacgcgctgcagaacaagcagaaggcgcgagtgtgttggcatttgatgacggggatgcgatggatcgctcagcgcccttaacggaggctacgcaaggtcagatcaatgtgcaattgctgaatgaaattggttacgatgcagcaaccatcggcaataatgaaggtgtcggtaacccgcatgatgtgctggaacatttatacgatcatgcgaactttccagtggcactggctaatttattcgaggttgacggcagccgaccgacatgggctaaaccgtttgtgcgaacgcaaacgcgtgctggtacacgcattgcgattgtcggattcacggcgccattttttctgacatatcgaccaaatggctggcaagttaaaaccgtggcggatgtatttccggatattttgaagcaattatctggtacctatgacgtgttaattgtgctgtcacatttaggaattgaggctgatcggcacttagcaaaacagtatccagagattgatgtcgtgattggtggtcatacgcatcatttattggcagacggcgagttacatggcaccaccttattaacagctgcagaaaagtatggccattatgtcggcaaagtgacgctgacgctggatgatcagcatcaaattatcacccgtcaggccgagacatttaaaactgagctcatgcaagcggcagctgctgacccgcgtgagatacagggctatgagagcaaaggaattgctttgctcaagcagcatcaggtggcgcggttgcccaaacagctatcgatcaaatatgatgggccttcaccattactggatttaggtttagaagcattggctgatggcgctcaggtggacgcggcgattttaaatgccggacttttccttatgccgctgggtccgggtgttgtcacccaagcggatttattaacctgtttgccgcatcccatgcatctgttaaaagtaacgctgagtggtaaggaactgtggcgcttaatcatggaaatggaaaagaatcggatgttcctgcgacattttcatatgatcggcatgagttttcgtggaaagatttttggtgacattggttaccggggtattagcgttaatcgtgaaaaacgggttgttctatggcacgggaaaccgttggtgccagaacaacaatatacgtttgtgacggtggacaattttctgttcattccattctttccaaccattgagattatgggcagcaatgaattgctttttcctaagctattacggaatgtggtgggcgagtacttagctcaaaaatatccattatgatttcgtgatatactttgcgaagcatcagcacacataaggaggtgagcacatgggcgaacatgaaccgcttatgcaacaaattgatgccgcattgaccccagaagctgataaagattcgcgggtggtcattgttaacggtgatttactaacgattgatggtcgccgctatcgccttgttaaggatcaccgaaatgcttttgatgttgcgcgtttgaacgaacgctacaacgaaattcttgataagtatgattatatcgttggtgattggggctatgatcagctgcgtttacgcggattctataaagatgatcgacgcggtgtcagcaaagaccagctcatcggcacacttgaagattatttgtatgaatattgtaattttggctgtgcttactttgttttggcgtgtttagacaagtcagtgacaaaagggcagccgcatcgtcgtcagggacatcgtgaggcggggcagagatcagagacgatcaaaccagtgcatcgccagacacccccaacaaatcggcgcaacagccaaaacaataagcataagccacggtcagcaaaagcggaaaaaccgtatacggaaaaaacaacccgaccaaccaaaattcgcggcgatcaggctaaaactatcaatcagacacaaccacgcaagcgacattttacgattcggcggcgtgagactaataagaagtagggacgaacttgaagtataaaggctatatgatcgatcttgatggcactatctatcgcggtaaggagcggattcccgctgcaaaggatttcgttgaacgactacaggcggcacaaatcccgtttttatttttaactaacaacacgaccaaaagtccagaagatgtggtcaaaaacttagcagagaatcatgatattcatgtccaaccggcgcaggtatacaccccggcactagcaactgcagcgtatctgaccgaccttaatcatggcgatgtgacgggtaagtccatttatatcattggcgagttaggcctcaagcaggcgttgctggatactggattacgattaaatgaagttgatccggattatgtggtcgtcggccttgactatgatgtgacttatcataagtttgaactggcaacactggcgattaaacgcggggcaaagtttattgggacgaatgctgacaccaatcttccgaatgagcgcggtttggttccaggcgcgggctcattgatcgcgctagtggagcgcagcacacagcagcgggctttttacattggcaaacccgaaccaacgattatggagaaagccttgaaaaaaatgggcttacctaaagaagcggttgccatggttggcgataattacaacacggacattaaggcagggctgaatgctggtattgatacgattttagtgtataccggcgtttctacccgtgattatgtttccaagcaagtccatcagcccacacatcagattgatgccttgacggattgggaggtctaacctccatgaagcgtattgcccaatgggtagcattgtggctagccatcattagtgtccttgtgttcatgacgattttaagtacgctgatcacttttccagtttatgcacacatggatgacctaccgcagattgccgtgatgtcccttggccggctttatcagaattatttgcagctgatggcttacttaaatttaccgtgggttggtactctgcatatgaatgatttccccacaagcgtacatggcgccattcattttgcggatgttcgccacctctttctcttcgatataggggttgctgtggtcacggtcccatttgcggtacgctggttgcatcaacttcgcattaccagaaaaagatatttgttggttcgtccgtttatgatcggggccgtggtacctgttgtgttgacggctatactagcggtgaacttcgaccaatttttcatcacgtttcatgaagtcctttttcgcaatagcgactggctgtttgacccagcaactgatccgatcatcaacgttttgcctgaaggattcttcatgttgtgttttctgacagcatttgctttgtttgaagctgtcatgatctggggcatttggcgcgggcgtcaagatgcgaaggtggcatgattggcagcgcaagcaaaaacgcatcgcttgtcacgtggaatttaccacatgacaggcgatgcgtttttttgatgcaaatcattttgctcagcgttcagtagctttagctgtccgggttttaatggcagcaatgaccatcggcagaagggaaatgatcacgataccgatggcaaccaacgaaaagtgttctttcacgaaggtgacattgccgaagtagaaaccgccgaaaacgcacatggtgacccagaggaaaccgcctaacaggttgtaatggataaacttgccgtaatgcattcgggagccgccggaaacaaacggcgcaaatgtccgaatcagcggcataaagcgggcgatggcaatcgtcttaccgccgtgcttgtcgaagaaagcctccgcctgcttcagtttgtcgcgattgatcagccgtccaaaccagccattgccagtggatgctgccgaaccaacgcgtttgccaatttcataattgacggtgtcgccaataaccgcagcagccagaaagacggcgaagagaatccacacattcaggttatacgcggcatttgcagccaacgcgcttgcagcaaatagcaatgaatcaccaggcaggaaggggaaaataacgacacctgtttcgatgaagaccatcgcaaaaaggatggcgtaggtccaagggccgaagctattaacgatggtaatcagatgctcatcaatatgcatgatgaagtcgaacagttgggtcatcttgtgaactcctttaatgaattacagcttattatacggattgatgtgaaaatttcatgaatcctgacagaattttaccaaaacatcaataaatgtcgtcttcaatttctggatgtgaatgagcaagtcgacttgctgcagcagcagcagtggctcccacgatatcatctaaaaaggtgtggataatgccaggctcatgggcgttcagcttagctaagatccctggcttgatgcgatcaatataaccgtaattggtaaaaccaatcgaaccatatacattgacaatcgagaaggcaagcacctcgtcaacaccatataaaccttcatcttcagcgatgattttttgcaacggttcttccaaactgttagcttctgctgccttgtccaaagcaataccagtcatcacagcattttgaacttcacgtttgcgtagaacaatgcgcacattttgtgtggcttcttcaagtgtcagcttggggatgaagcgttcttgcaggaacattacaagttcgccaatatcggatatccgaaccccgcgttcatgtaacagttgaatcgtgcggtcatacaatttttcttcattcgtcatgtttttgctccttgatgggtaaattgcgcagatgagcgttaatgatacagctgagtactgtgcaaggcctgacgtcgatctggatacaagcggcttaaggcctcattgatagcggttggcgcttctccaaaaccgctggcaatcagcggcaacttgccagcatagctgacagcatcgccaattgcaaaaatgccgggacgactcgtctgcatttgtgtgtccaccagtataccattacgatccgtgtcaagttgccaagcctgtaggtggtgtttatcggtgacaaatccatagttgatcaacagcttgtcgacggtgagcgttggctgtgcctcgccgcgaacttccttcaattgaatcgctaactgatcatcttgaggggtgactgattcgatcaggtaaggcgtctggattgtcacactgcttttttcaagtgcagcaacactggcttccaagccgcgaaatttggcacgacggtgaatcagactgacatgtttggcaaccggttcaagtgccagtgcccaatcaattgcagaatcaccaccaccagccacggccacttcctgatctcgaaaagtttccaaatcctgcacgaagtagaacagttttttgccttccaatgccggatcatagtcaacagctaacttgcgcggcgtaaaagcaccaccaccggttgccacgatcacagttttactgcggaaatcgccttgacttgtatgcaatgtgaaaaagccatctggatcttgatcgatcgtctgtacttccgtagcggtcttgacttcaggatgaaaatgcacgagctgagttttgagctgcgtgacaaggtctttgccactaacatgcgggaatccgccaatatcatagagaattttggcagggtataagttgcctgtttggccgccaagctcgtcaagactctccaataacaaaacgtctgcctggcgcaaacccgcataaaaagcggcgaacatcccaaccgggccgccgccgattaccgtgatttcatatacatgctgcactgacatttgcaatgctccgtttctatatagtatgacgtccatacactaccatattttcacgataagtaccaaaataggccgaacaccggtctgtcaagtgtgatgagcccgtaagcagcctttttaatagacgatcgttgcatcagcaaacctgtgtagtttgcgctcaggggctgggctggtatactacgcctagtacaagaacgttaacttgtaaaggagattgatcatggattacccacaattagaactcaaagactttaagggaccaaaagcgatttttgaaacaagcgaaggtcgctttgaaatcgcacttttccctgaacaggcgccaaagacagttgaaaactttgtaggccttgccaaaaaacattattacgacggtttgatctttcaccggattattgatgatttcatgattcaaggcggcgaccccaccggtaccggcatgggcggtgaaagtctctgggggaagccctttaatgatgagttttcaaatcagctattcaatttgaaaggtgcactttcaatggccaatgctggtccaaatacgaatggcagccaattcttcattgtgactaatgcgcatttagacccgagcatgcaggcgcaactaagtgaggctggattcccagaacccatcattgaagcgtataaacaaggcggtacaccgtggctcgatcatcgccacacagtctttggccaagtcctaagtggcctgtccgtggttgagaagattagtaaagtcaaaacaggtgctaatgataagccggttgaaccggtcacgattgatcaggttacgattgaagactaatattggtcggcaatgatttttagggtatactcaaagagaaatccaatgaaatgaagtgtcagaatggaatatcgcataggagatatcttgactggcaaagtgacaggcgttcaaccttatggcgcgtttgtcatgcttgatgagcacacgcaaggtttagtgcacatctcagaatgccagcatggttatgtcaaggacaccagcgatatttttaccgtcggccagcgagttgaagttgtgattttggacatcgacgaatatacccaaaaaatcagtttatccttacgtgccttacaagcgtcgcctagaatgagtaaaaagcgtcgccgcaagcattattggaccagtcgtaaatttcacacaggctttgcaccgattgccgctcggttagacgggtgggtcgctgaagcacttgatcatttagacgaagaaccggctcacaaatgagtcggttctttttttctgaacttttgtcacgatgaatagaataatgttcgcagaaatgctgaatttttatgcaattttggagaaaacgttcgcgatctttcggtattttaaaatgtttcaatttgcatgaattttttattgactacatcgttaaagtgctggtatgatacttgttgttgtcaaaacaaaaggcgctgatctttagcggatatacttaattagatcaagttgatggcttgcacaatgtgcgacgtcgagaacagatgaataaatattcaatgtttaaaaaaacgttgacatgtaacgctggtcatgataatctatcaaagttgtcttttgacaaggtcgtcctttgaaaactgaacaaagtttcgtttaaatgtgcagggtccttggtacttcggtaccgaggcaagaagtaacatttgcgaagtcaattcgctagaacaacaaatcgagctattcgaacagctcatatttatatgagagtttgatcctggctcaggatgaacgctggcggcgtgcctaatacatgcaagtcgaacgagttctcgttgatgatcggtgcttgcaccgagattcaacatggaacgagtggcggacgggtgagtaacacgtgggtaacctgcccttaagtgggggataacatttggaaacagatgctaataccgcatagatccaagaaccgcatggttcttggctgaaagatggcgtaagctatcgcttttggatggacccgcggcgtattagctagttggtgaggtaatggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaaacagactgaaagtctgacggaaacctgcacacacgaaactttgtttagttttgaggggatcaccctcaagcaccctagcgggtgcgactttgttctttgaaaactggatatcattgtattaattgttttaaattgccgagaacacagcgtatttgtatgagtttctgaaaaagaaattcgcatcgcataaccgctgacgcaagtcagtacaggttaagttacaaagggcgcacggtggatgccttggcactaggagccgatgaaggacggaactaataccgatatgcttcggggagctataagtaagctttgatccggagatttccgaatgggggaacccagtacacatcagtgtattgcttgtcagtgaatacatagctggccggcggcagacgcggggaactgaaacatctcagtacccgcaggaagagaaagaaaactcgattcccatagtagcggcgagcgaagtgggaagagcccaaaccgagaagcttgcttctcggggttgtaggactggacattggagttaccaaagtccgacgtagtcgaagtcagctggaaagctgcgccacagaaggtgaaagccctgtaagcgaaacgtcgaaccctccgtccaggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaacagttcctgaaaccgtgtgcctacaattagtcaaagcccgttaatgggtaatggcgtgccttttgtagaatgaaccggcgagttacgtttgcttgcgaggttaagatgaaaagtcggagccgtagcgaaagcgagtctgaacagggcgaatgagtaagcagatgtagacccgaaaccaagtgacctacccatgaccaggttgaaggtgtggtgaaacacactggaggaccgaacccatgtatgttgaaaaatgctgggatgagttgtgggtagcggtgaaattccaaacgaacttggagatagctggttctctccgaaatagctttagggttagcctcggaggatggatcatggaggtagagcactgtttgaactaggggcccatcaagggttactgaattcagataaactccgaataccatcgatcttactccgggagtcagacagtgagcgataaggtccattgtcgaaaggggaacagcccagatcaccagttaaggtccctaaatttatgctaagtggaaaaggatgtggcgttgcacagacaactaggatgttggctcagaagcagccaccatttaaagagtgcgtaatagctcactagtcgagtggcactgcgccgaaaatataccggggctaagcataataccgaaactgtgggtgcacccgtaagggtgcgcggtaggagagcgttctaagggcgttgaaggtcgatcgtgaggacggctggagcgcttagaagtgagaatgccggcatgagtagcgaaagatcagtgagaatctgatccaccgtatgactaaggtttcctggggaaggctcgtcctcccagggttagtcgggatctaaggcgaggccgagaggcgtagtcgatgacaagcaggttgagattcctgcactagtttattttgtttaagcgatggagggacgcaggaggctaaggaaagcgcacggctggaaatgtgcgcccaagcagcaagtctgacagcgagtgaaatgcttgcagtcttaaggacaagctgtgatggggagcgaaattatagtagcgaagttcctgatgtcacactgccaagaaaagcttctagtgagaaataaactacccgtaccgcaaaccgacacaggtagtcgaggagagtatcctcaggtgagcgagcgaactctcgttaaggaactcggcaaaatgaccccgtaacttcggaagaaggggtgctgaccgcaaggtcagccgcagtgaataggcccaaacaactgtttatcaaaaacacaggtctctgctaaatcgtaagatgatgtataggggctgacgcctgcccggtgctggaaggttaagaggatgagttagcgcaagcgaagcccagaattgaagccccagtaaacggcggccgtaactataacggtcctaaggtagcgaaattccttgtcgggtaagttccgacccgcacgaaaggcgtaatgatttgggcactgtctcaacgagagactcggtgaaattatagtacccgtgaagatgcgggttacccgcgacaggacggaaagaccccatggagctttactgtagcttgatattgagtgtttgtaccgcttgtacaggataggtaggagccgtagagatcggaacgctagtttcgatggaggcgttggtgggatactaccctagctgtatgaacactctaacccgcgccactaatcgtggcgggagacagtgtcaggtaggcagtttgactggggcggtcgcctcctaaaatgtaacggaggcgcccaaaggttccctcagaatggttggaaatcattcgcagagtgtaaaggtataagggagcttgactgcgagactgacaagtcgagcagggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgttccgctggtgtaccagttgtgccgccaggcgcatcgctgggtagctatgaacggcagggataaacgctgaaagcatctaagtgtgaagcccccctcgagatgagatttcccattcctatatggaagtaagacccctgagagatgatcaggtagataggctggaagtggaagtgcagcgatgcatggagcggaccagtactaatcggtcgaggacttaaccaagtaagagtgtgagcaggagcggttagaaaccggagcataagcgggcctgagcgtgatggccgggctttggccattgcggtcagggtccttatgtgcaggtttctgcgactgcgaacacgtttcgatgacaagtacgttaagttcaaggcagcaattaaacaatgatagccagttttgagagcgcaaagttctcataagtgtggtggcgatagcaagaaggatacacctgttcccatgccgaacacagaagttaagcttcttcacgccgagagtagttggtgggaaactgcctgcgagggtaggaagctgccacgcttacatatggaggattagctcagttgggagagcgtctgccttacaagcagagggtcacaggttcgagccctgtatcctccattgagccgttagctcagttggtagagcaactgacttttaatcagtgggtcgacagttcgagcctgtcacggctcagagaattattggttttaaatggcggctcaagtcgatttttcgccgacttagctcagttggtagagcatctgtcttgtaaacagggggtcgaaggttcgaatcctttagtcggcatggtaccaataatttgatagcaccatgtttcatgcggaagtagttcagtggtagaacatcaccttgccatggtgggggtcgcgggttcgaatcccgtcttccgctttccaagcacagtgccgagggtgtgcttggtcaaacctatcctcggcattatcatgatttgcacccatagcgcaattggatagagtgtctgactacgaatcagaaggttgtaggttcgactcctactgggtgcattatcgggaaatagctcagcttggtagagcacctggtttgggaccagggggtcgcaggttcgaatcctgttttcccgattggacatttttgtcccttagtttttcgcggtgtagctcagctggctagagcgtccggttcatacccgggaggtcgagggttcgatcccccccgccgcgattgagcttggacctttagctcagttggttagagcagacggctcataaccgtccggtcgtaggttcgagccctacaaggtccatctttacagggtggtcgctgttcggtataatcgatatgttattgttatcgcgggatggagcagttcggtagctcgtcgggctcataacccgaaggtcgcaggttcaaatcctgctcccgcaatttatatggttccatggtctagttggttaggacgcctgcctgtcacgcaggagatcacgggttcgagtcccgttgggaccgtttgcggctcggtagctcagtcggtagagcaatgcattgaagctgcatgtgtcggcagttcgattctgtcccgcgccatattcataatcatttttatgcgggtgtagtttagtggtaaaaccacagccttccaagctgttgtcgcgagttcgattctcgtcacccgctgcggttatgatcatgggcctatagctcagttggttagagcgcacgcttgataagcgtgaggtcggtggttcaagtccacctaggcccattgttccatttatagtttcatatacacatggagaagtactcaagtggctgaagaggcgcccctgctaagggtgtagaccgggaaactggtgcgagggttcaaatccctccttctccgttgtggcccgttggtcaagtggttaagacaccgccctttcacggcggtaacatgggttcaaatcccgtacgggtcatgtttagatggagaattacccaagtctggctgaagggaacggtcttgaaaaccgtcaggtgggcgtaagtccacgcgagggttcgaatccctcattctcctttataattatcgcgggatggagcagttcggtagctcgtcgggctcataacccgaaggtcgcaggttcaaatcctgctcccgcaatttatatggttccatggtctagttggttaggacgcctgcctgtcacgcaggagatcacgggttcgagtcccgttggaaccgtctctctcaattgagagaaaaatacaatagtttagttccaaatggctcggtagctcagtcggtagagcaatgcattgaagctgcatgtgtcggcggttcgattccgtcccgcgccattatggaggagtagcgaagaggctaaacgcggcggactgtaaatccgctccttcgggttcataggttcgaatcctatctcctccattttatagggatatagtttaatggtagaactacggtctccaaaaccgtcagtgtgggttcaactcctactatccctgcttttataatggcggtattggtgaagcggttaacacaccggtttgtggcaccggcatacgtgggttcgatccccacataccgccctttttactggggtatagccaagtggtaaggcaacggactttgactccgtcatgcgctggttcgaatccagctaccccaatttctccaactgccataggggaaaggcacttaattgaaatatggcggtgtagccaagcggtaaggcatgggtctgcaaaaccttgatcgtcggttcgattccgatcaccgccttatcttgcggcaatcgccaagagagtgtattatcatttaatattatgccggtgtggcggaattggcagacgcgcgggattcaaaatcccgttccagcgatggagtatcggttcgaccccgatcaccggtatcacaaaccttcctaggaaggtttttttttgccttgaaaatctgtgccacaaacaaagatgttcccaatacatttttgatcacacccgatttaaaaaagtgtacaatttggcacaaatcatggagccgctgtttttgcatgaaaattgtatgatttctgacacacgaaaaaaagacccagcgcttcttcatcctacgtaaaagtaagatgctcctgagtcttttttcgttatctgatactgtcctttttgacgattgctgccagttgacttgctattcttcgcgagagaacttcaatatcttgatccaagaccgttccaatgcgcgacgatgacgctgcagcaaaggatcttcagaactgtctgtctgactgatgacagctgcctcgaaggcctcatattccaaaggtgacaaccgtgccagaaattgtgcaaactcgattcgcatgagtagaccatcttcatacgatctgagagccagacgttcttgaagagattcaagtgcgctgtcttcaactgggattgcggtcgcgtcgatgcggcgtttatgcgcaaagtgtttccgcaagactgaacgtaggtgtgactgcaataccattcgatagtagggaccaaattgggatccgctagagccatcatatcgagtaattgctttgagcatcgcaatcctggcctcttgtaaccagtcttcatgtgaaaaatccctgagatggtacggtcttaacaccgttaggactagcggtcgatattgcttaaacaattggctgaatgcagttgagtttgtgattgcttcattgattaatgttaactctgtggctttcatatctcctcctcccccgacttactagctttttcattctacaataaagcgtttccaattgaatagcgaacaatcgttcatgaatattttttaggggaacagaatgcttacaaccaaaggcatatgttggggcaatattgacaacattattttagtatttttttcacgatttttttaagaatcacgacatctttaaaagaatagaaaggggccagtagaatgacctattgttaattggtgattcggtggccggagagcgtgttattacaagcatgatttgaaaattggtatgacaaaaaatgatgatattttaatggcgttaaggcagctttagatatcttagaacggcaattttaaaaaaataatgttggcgccttcatatgcgataccatcggaaaatagcgaatttataaagaataatcaattttacattgatcatgacatgcgttatattaaacgagtcacttttttagggaggtattcgataatttcttcaaataaagaaaataataaaattggtctatttcagttagttatgctagctttgggttccttgattggttcaggctggctctttggttcttgggaagcagcagcagtagctggtccggcggcgattctgtcttgggtgattggcggcttgattattggcatcattgcttataattacattgagcttgggaccatgtttcctgaatcaggcggaatgagcaaatatgctcagtactcgcacggctctttagttggctttatcgcttcttgggccaactggatctcgctagtgacattgctgccgattgaagcagtggctgccgtgcaatatatggcatcatggccgtggcagtgggctagctttacgcacggttttttggctgatggtcgtatcacatcgcaggggttgctggtggtgtttgctttcatcattatttttacgttacttaactattggtcagtctcattactgacacgattcacgagcttcatctcgatcttcaaaattggggtgcctttgctgacgatcacgctgttggcactttcaagcttccatcccggcaattatgggcattctttagcgaccttcatgccttatgggagcgcacctatctttgcggccacttcagtttctgggattattttttcctttaacgcgtttcaaaccgtcatcaacatgggaagcgatgttaagaaaccgcaaaaaaatattgggcgcggaattgcaatttcgttactgattagtgcggtcatttacattttattgcaaagtgtttttatcacgacaatttcgccgaagctgttagcagcacatggttggcaagggttgaatctcaactccccatttgctgacttggcgattctgctgggtattcactggttatcagttttgttatatatggatgcctttgtttccccgtttgggactggcgtttcatttgttgcttcatctgggcgggcgttgcaggcgatggtcagcaacaaccatattcccaaatttcttgggaaacttgatgaaaagtatggtacaccacgagtggcgatggtggtgaatgcgttgcttagcatggttatggtttcgatttttccatcttggggtacgttagctagcgttatctccacggcaacgttgattgcttacctgacaggtcctattacggtcatctccttgcgtgacatggccccggattttaagcggccagtgaagtcgagcctcttgcgggtgatggcaccattgtcatttgtgctaacctcattagcggcttactgggcaaaatggccgacaacggttgaagtgatcggcgttattttcttgggtattcctttctatttgttctatgaatggcgatcaggctgggcaagcacgcttaagcaattgaaggcggcagcttggatgctggtatatttgctattcctgtcactcatctcacttattggcagcagtgagtttaatggtttgaattggattcactatcctttagattttgttgtcattatcattggtgctttgggcttttatgcttggggaattaatagtcacattttctctaaatatttccgacgcgctgcaagagtgaatgacaaagttaaaatgccgcggcagtagcaacttttattagaaaaaacacgtctctggtcagaaacatgatcatcgacgtgttttttggtatgatggaagacattctgattcttggccattgccgcagatgctttgagccgccggtggtgaaggctcgtttgataaaatactagatggcataacttacgacttttgcctgatgatggtgtgatggcgacaaggtaagataattttaaaggtttgagggaaaattgcatttagctatgcctatctttatacttatactaaacaaatgacgtctggaggggattaggtgaatatcgggatttttacagatagctactttccacaagtcagtggcgtcgcgacgtccatcaagaccttgaaggacgatctggagcgtaagggccatcaggtttatatttttacaacgactgatccgcatgtgccggacgacgccgttgaacctaatttattccgatttaccagtgtaccgtttgtctcattcacggatcggcgaattgcggttcgtgggctttttcatgcttacgcagtggcgaaggaattgaacttggacattgttcatacacaaactgaattttcgatggggtatatcggcaaatttgtcgccaagcagttgaaaattccgacaatccatacttatcacactatgtatgaggattatctgcattatgtcctgaatggtcatttgctgaagccttatcatgtgaagcagtttacgcgggcgtttctttatcatgtcagtggcgttgttgcgccttctgaacgcgtttatgatacgctgcgacgatatggcgtcaaaactgagatcaaaatcattccaactggggttgatttgactcagtttgcccagcaaaaagatccgcatttacgtgacaagctcgggttggcgcatgtcccggttttggtctcactcagtcgggtcgcgtatgaaaagcgaattgataaggtgatcagtgccatgcctaaaattctggaacaggtgccccaagtggtgctgttaattgttggcgatgggcctgcgcgtgaagacttagaggcgcaagtcgctgagctgggtctcaaggagcatgtccgattcaccggtgaaattgaccatgatgatgttggtgactattaccgggttggcgatgtgtttgtatcggcaagtgactccgagtcacaggggttaacttatatcgaagcgatggcggcggatcggaaagtggttgccttgacaggggattatacggatcaacttttggatgatccggcgttagggacaacattttcaactgagactgaaatggtgcatcaggtcgtgaattacttgaaacatccaaatgcttacgatgatgctaagccgcgtcaagaaaagttagcggcaatttctgcagatcgatttggcgatcgggttttggatttctatcaagacattttgtcacactattcgcctaatgaggccgatgaagctgcaccatggaccgatgaagattccagtaaacggaccatgaaaggttaaatatgattgttattaatatgttttcctctgccaataaggttgcaggacaaggagttggcgcagtctacacagaactgatgggcttgctgaaacatgatttttcaaatgaatttgaagttaacgtcaatcgttatacgcgtagtgacatcagccattatcatacgattgatcctaaattttatttatctactttctccaaaaaacggggtcgcaagattggctttgtccactttgtgccgagtacactggatgcgagtctgaagttgccgcgagtggcgcggtggacgcttgataagtatacgttggctttttataagcgaatggatcagttagtggtggtgaacccgaattttattcctaagttagaagcttatgggatcagtcgcgacaaagtgacttatattcctaatttcgtatcgcaacgaacgtttcatccagtatccactgaaaagcggcaggctttgcgacatgccaatggctttaaacctgatgattttgtcatttttggcgcgggtcaggtgcaggatcgtaagggtgtcagcgattttatcaaattagcaaaacaaaatccggaatttcgttttgtttgggcaggtgggttctcttttggccgcattactgaaggctacgaccatttgaagaaggccgtagcagaagccccggcaaacttggatttcactgggattatgccacgagagacaatgattgactattacaatatggccgatgttttcttattgccttcttatgaagagctgttcccaatgtccgtccttgaggcttttgcaacgggaacgccagtgatggtgcgggatcttgagctgtatcaccaaatcatcacaccttatgccatcacggctgttgatgttgacgatatgcagtctcgattgcgagcacttgcggatgatcatgatcttttggcaacttatgcaactaagagtcgacaagctgctgaagtttacgatgaaagccgacttgaaaaagtctggcacgatttctatcttcatcaagctgcactggggaagcactagccgaggagttatatgacacggaagaacaaactggctgtcttaatcatgattttgattggcgccggtatttttatttatgaagctcgtgatctgaacggcgcacaattaatccacgaactattgacgcttgatctcaagtggctgctggtggcttttttgctcatgtttgggtcgtggatcattgaaacctttgtggttcagatctttattcgaagtgaagctgatgacttagactttaaaaccgctttgcgtgtgccgttggttgaacaattgtttaatgcaattacgccgatggcttctggtggtcagccagcccaattatttgctttgatgcaaagtggcgttgaagctggccgggcaagttccgtgttgttgatgaagtttgtcgtgtatcaattcatggtcctgattaactttgtcctgacactattcatcgggtttgatcaggtgtccaaacattttggggcgcttgctttgttcatcgtttttggttttgtgattcatgtggttgtcatcgtaggcttgctcatggtgatgtattactataagttcacaaaaaaattagtgaatttggtgatgataccgattggctggtttgtcaaacctgagaaaaaacttgccatgcaaagtaaccttgatcataaaattgacactttttacgcagagagtttgcacttgaaacgcgaaaagaagcgggtcatcaaggcttgcttgttgacacttgtgcaattgctgctttactatgcggtgccgtactttgtgctcctgtcgcttggcgtaagtcatgttagtatcgttgaggtcatcgtgttgcacgtgatgattgtgatgattgtcagcctgtttccgattccaggcggtgctggcggggccgagtatagctttaagaccttgtttgcgacttatgttgcgtcgccttcaaaattgattctagggatgctgttatggcggttcttgacctattacctagggatgatctgcggcatcattgccatggcattcccgccaaaaagcaaacgtacgtgagcgactgagaaatgtcaaagctcagggagggcgaaatgtcgtcagcaagcgaagaactgaaccagtattggcctgcctttagacaaagcaaacgttatgcgccattgttagggatcggagacgccgagattaagcatatcttgaccggtatcgttgaattggtgatggctcaaaatcagcatcacattaaggcatggcaaatcaacgaaattgctgctgccctgagacctgctttggagactagctgggccaccccaaaacaggagcagcgaattttggcacgatatgcttcgtgggtgaatatttttttaacatggctggcagaagccggtaaggtcgcatttacatcggcagacgttgctgctgtgatggcgatactttatccgtaagctacatgtcgataaataaaaagcgcttggttatcagaccgattttgatctgataaccaagcgcttttatctattgtcttcaaaactaggcggctttatgcgcagctatgaatgcttgtaaacgtttgactgcctccttgaggtcagccatggaagccgcatagctgatgcgaatataaccttcgccaccagggccaaacgcagtacctgagatcagcgcaagtttctgctctgtggcaagcgattgcgtgaattgtcgcgaatcaagccccagttcgatcgggattttggcaaaaagatagaaggcgccatccggccgagcaacatcgaagcccatgtccagaagcgcctgatagacaaaatcgcggcgcttggcataggcggctttcataacctgtgcatcatcttgtccgttcgtcaaagcttcaatgccagcgcgttgtgcaatggtggttgccgcggtgacgagatactggtgcacttttttcgcctctgcgatcaaaactcgcggacccatcaaaaaaccgattcgccagccggtcatggcatgtgattttgacagaccattcacgacaaaagttcggtcgtaagcataattgcccatggaaacatgtgagtcaccataagttagttcggaatagatctcatcgcaaataatataaagatcatgttcagcagcagttgcggcaatcgctttaacctcagacgcacgataagtgacgccagtcggattgcttggatagtttaaaatgatgccttttattttggcatcaggatgagcagcaatcgttgcttcgatcagcgctggggtcaagacaaagttggttttgctagtgtccatatagatcggtgtcacatgattcaacgtaagcaaagggatgtaccccggataaatcggtgacggcaccagcatggcatcacctggatcgctgatggttgtaatggcagttgccaaagcctcggtagcgcccacggtgacaagaatttcatcttcagcagcgtaatcagtagcatattttgttttgaaaaagtgttgcgcagcttcccgcagttctggatcacccaccattccggtataatgagaataattttcctgaatagcttcaatgccagcctgtttaacgtgctcaggcgtattgaaatcgggttcacctaacgttaacttcaaaataccgggaatcttgctgacgctttcgtcaaattgccggatttcactaacgtcgatatcggctaattgtttatttaatggttgcaacttcatgggcgatctccttagtatgtaggttgcaaatagcatagtccattttccctcatagttgcaatgcaataaaactgcaattcaaagagagatttctcccacagaggccgtggtttatgctaagctatttcttgaaataggaaaaataaacagcgcgtgatcccgcccacatgagattcgacgtgtcagtgccaatgattggcatgttggctcgcaaggtggtgatcgcgtttataggaggccattttatgaaacaatcacagctcgtggccatcatcaagcgcctagaagccatgcaggcaggcgatggcgagacccagtcgcgccgcttcgaaaaaaatggtgatgaaaagggcctcgtgacatacgatcccaagaccgaaacttatgaacttgaggaattaggcactcaccaaacctttcagtttgataatatcgatcttgcggccatggaaatctatgatttgatggattttgatgaagacgatggcacaagtgacagcaccagcgatcaagcaccagcttgatcaacgacaaaagcgaactgacaaggttcgctttttgtgtagcacatgatcagaagcgcttggaaatggtattcagtagccgtcaaaacctgatccgaatttaaaggcttctttaaaatcaccatggattggcccaaataggtccagaaagtttgtctttttcaaaacaagcggttatcctagcgaatgtgctatacttttgacattaaacaatgacttggaggctccacatgaaccagcttggcagtaaactcaggggattttttaatacccggctcgggttttttgtgcttgccatcgtccttttttgggcgaagacatactgggcatatcaatcaaaattcaatctgggcgtcaccggtagctttcaacatctgatcttggcgatcaacccgattccaaccacactgttcctttttggcatcgcactatacatgtcagggcgtaaatcgtacattacgatgctgattattgatgcacttacatcggtgtggctttttgccaatgtcctttactatcgagaattttcggactttctgacatttgcattgatcaaagggtcaggcgccgtgtccaataacctcaataaaggcatcatgggtattgtgcaaccaacagattttattgttttcgctgacgtcctcattttgattctgttgcttgtttttaaagttatccggatggacattcgaccgattaagaaacgctttgcactcggggtttcggtgttagcagtcgcgatgttcgcagctaatctcagtatggcttatagtgaccgttcaggcttactgacgcgtacctttgacaataactatattgttaagtatttagggcttaatgcctatactgttgttgatggggtcaaaacagcacaaaacagtgccacgaaagcaaacgccgattcgagtgatgtgaaatctgttttgaattatcttaataagaacagagtcacacctaatgcgcaatatactggtgttgccaaaggaaagaacgtttttgtgatccatttggaaagccttcagcagtttatgattgacttcaaatgggatgggcaggaagtgacgcctaatctaaataagctctatcatgaatctgatacgttatcctttgacaatttctttaatcaagttggccaagggaaaactgccgatgctgagatgatgatggaaaactcactgtttggtttacctgaaggggcagccatggttaccgatggcacaaccaatactttccaggcagcgccagcaattttggatcagcaaggttacacaacagcatcattccacggcgatgtgccgagtttttggaaccgagacaacacctataagtcttggggctatgactacttcttctcgaaaaactatttttcaagtgggaagaactacgatgtcggctatgggctaaaggataagattttcctcaaagactcagctcagtacattgagcaattaccacaaccgttctatgccaaaatgatcacggtcacaaatcactatccgtatactttggataaagccaatcaaaccatcgagaagacggatactggcgacgataccgttgatggctatgttcaaactgcccgttatcttgacgaagcactgggtgagtttttcaattggttgaaggaaactggtctgtatgacaaatcaatgattgttctttacggtgatcactatggtatttcgaataaccataaaaaagccatggcaaagcttacgaacatttctggtttcaatgattataacaacgccatgtaccagcgagtaccatttatgattcacatgccaggcttaaaaggtggtattaatcatacgtacggtggtgagattgacgcactgccaacaatattgaacctgttaggtgtgaaagataacgatacagttcaatttgggtccgacttgttatccgcggatcatccgcaaaccgtggccttccgaaacggcgactttgtcacgccagactttacaaaggttggtagtcaatatttcaataccacgactggtaagaaaatcgacaagttatcagaaagccagaaggaaagtgttgatgcgtccactaatcgagtgaccaccgaactttctctgtctgatcgcgtcattaacggcgatttgttgcgattctatacaccggccggctttaagaaggttgatcgaagtgacttttcatataagctgacagatacaaagaaaaagttgaaagccgcgcaaaagaagggcacgagtctaaaagcggaaaacaaaggtaagtcagttgccgatgagtataagaccgatgcacctgaacttaaagacgatagcgatagcagcagtagcgagtcaaagtagcaatcgaattcagtgaaagcagcgttcagcggcgagcgctgctttttctgtgtccacaaaatgtgctgtagtgaatgggattactgacctgaagctgcttattctgaacttttgtaagtaaacagttgtgctagattagaaaagagcgtacaattttactagatgataatagttataaataggaggctggctatgaatcaggcggtttacaacaaaacaattaacttgctcaaagcgaagcagattcgggtcaccccgcagcgtgaagcgattatttcgtacatgattgacagtacggcacatccgactgcggaaatgatttatgcgaagctgtcgccgcagtttccgcatatgagtgttgcaaccgtatataataatctacggcttttggttgatcttaatctagttgaagaaatgtcgtctaatgatgcggccactcattttgattttcccattgagccacattatcacgccatttgtacaaactgcggcagaatctttgacttcagttatccaggcgttacagatgttgaagcagtggcggctaagaaaaccggctttaaagtgagtggccatcacctcgaagtttacggtatttgccctgattgccaagtgaaattaggtatgaagtaattgagtccaataaggtggtgcattacggcgattaagtcgtatgtaccgctttttgttgggtaggttaagcaacatcacgcaacaatcaattaggccgtatggacaggagcatcgcgtggttttgctggaaactaaaaaaaatacttgcacaccgtctgagttgctggtatcatattattgctgtcaaaaagcaattccttttctaaaaagggtaaggtagaagcgcttgcatcttccatttaacaggatatttaataaaaatgttgacagttgtttgtcagcgtgataatctatcaaagttgtcttttgacaaggtcgtcctttgaaaactgaacaaagtttcgtttaaatgtgcagggtccttggtacttcggtaccgaggcaagaagtaacatttgcgaagtcaattcgctagaacaacaaatcgagctattcgaacagctcatatttatatgagagtttgatcctggctcaggatgaacgctggcggcgtgcctaatacatgcaagtcgaacgagttctcgttgatgatcggtgcttgcaccgagattcaacatggaacgagtggcggacgggtgagtaacacgtgggtaacctgcccttaagtgggggataacatttggaaacagatgctaataccgcatagatccaagaaccgcatggttcttggctgaaagatggcgtaagctatcgcttttggatggacccgcggcgtattagctagttggtgaggtaatggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaaacagactgaaagtctgacggaaacctgcacacacgaaactttgtttagttttgaggggatcaccctcaagcaccctagcgggtgcgactttgttctttgaaaactggatatcattgtattaattgttttaaattgccgagaacacagcgtatttgtatgagtttctgaaaaagaaattcgcatcgcataaccgctgacgcaagtcagtacaggttaagttacaaagggcgcacggtggatgccttggcactaggagccgatgaaggacggaactaataccgatatgcttcggggagctataagtaagctttgatccggagatttccgaatgggggaacccagtacacatcagtgtattgcttgtcagtgaatacatagctggccggcggcagacgcggggaactgaaacatctcagtacccgcaggaagagaaagaaaactcgattcccatagtagcggcgagcgaagtgggaagagcccaaaccgagaagcttgcttctcggggttgtaggactggacattggagttaccaaagtccgacgtagtcgaagtcagctggaaagctgcgccacagaaggtgaaagccctgtaagcgaaacgtcgaaccctccgtccaggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaacagttcctgaaaccgtgtgcctacaattagtcaaagcccgttaatgggtaatggcgtgccttttgtagaatgaaccggcgagttacgtttgcttgcgaggttaagatgaaaagtcggagccgtagcgaaagcgagtctgaacagggcgaatgagtaagcagatgtagacccgaaaccaagtgacctacccatgaccaggttgaaggtgtggtgaaacacactggaggaccgaacccatgtatgttgaaaaatgctgggatgagttgtgggtagcggtgaaattccaaacgaacttggagatagctggttctctccgaaatagctttagggttagcctcggaggatggatcatggaggtagagcactgtttgaactaggggcccatcaagggttactgaattcagataaactccgaataccatcgatcttactccgggagtcagacagtgagcgataaggtccattgtcgaaaggggaacagcccagatcaccagttaaggtccctaaatttatgctaagtggaaaaggatgtggcgttgcacagacaactaggatgttggctcagaagcagccaccatttaaagagtgcgtaatagctcactagtcgagtggcactgcgccgaaaatataccggggctaagcataataccgaaactgtgggtgcacccgtaagggtgcgcggtaggagagcgttctaagggcgttgaaggtcgatcgtgaggacggctggagcgcttagaagtgagaatgccggcatgagtagcgaaagatcagtgagaatctgatccaccgtatgactaaggtttcctggggaaggctcgtcctcccagggttagtcgggatctaaggcgaggccgagaggcgtagtcgatgacaagcaggttgagattcctgcactagtttattttgtttaagcgatggagggacgcaggaggctaaggaaagcgcacggctggaaatgtgcgcccaagcagcaagtctgacagcgagtgaaatgcttgcagtcttaaggacaagctgtgatggggagcgaaattatagtagcgaagttcctgatgtcacactgccaagaaaagcttctagtgagaaataaactacccgtaccgcaaaccgacacaggtagtcgaggagagtatcctcaggtgagcgagcgaactctcgttaaggaactcggcaaaatgaccccgtaacttcggaagaaggggtgctgaccgcaaggtcagccgcagtgaataggcccaaacaactgtttatcaaaaacacaggtctctgctaaatcgtaagatgatgtataggggctgacgcctgcccggtgctggaaggttaagaggatgagttagcgcaagcgaagcccagaattgaagccccagtaaacggcggccgtaactataacggtcctaaggtagcgaaattccttgtcgggtaagttccgacccgcacgaaaggcgtaatgatttgggcactgtctcaacgagagactcggtgaaattatagtacccgtgaagatgcgggttacccgcgacaggacggaaagaccccatggagctttactgtagcttgatattgagtgtttgtaccgcttgtacaggataggtaggagccgtagagatcggaacgctagtttcgatggaggcgttggtgggatactaccctagctgtatgaacactctaacccgcgccactaatcgtggcgggagacagtgtcaggtaggcagtttgactggggcggtcgcctcctaaaatgtaacggaggcgcccaaaggttccctcagaatggttggaaatcattcgcagagtgtaaaggtataagggagcttgactgcgagactgacaagtcgagcagggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgttccgctggtgtaccagttgtgccgccaggcgcatcgctgggtagctatgaacggcagggataaacgctgaaagcatctaagtgtgaagcccccctcgagatgagatttcccattcctatatggaagtaagacccctgagagatgatcaggtagataggctggaagtggaagtgcagcgatgcatggagcggaccagtactaatcggtcgaggacttaaccaagtaagagtgtgagcaggagcggttagaaaccggagcataagcgggcctgagcgtgatggccgggctttggccattgcggtcagggtccttatgtgcaggtttctgcgactgcgaacacgtttcgatgacaagtacgttaagttcaaggcagcaattaaacaatgatagccagttttgagagcgcaaagttctcataagtgtggtggcgatagcaagaaggatacacctgttcccatgccgaacacagaagttaagcttcttcacgccgagagtagttggtgggaaactgcctgcgagggtaggaagctgccacgctttttttattccggtttagctcagttggtagagcacctgactgttaatcaggttgtcgtcagttcgagcctgacaaccggagttttttatggagagttgtccgagaggctgaaggagcatggttggaaaccatgtatacgggttttacctgtatcaagggttcgaatcccttactctccgttgtcttgcattcggatgtagctacataagaagcctcaaaacgctgttaattcggtgttttgaggcttttttgaacatcaaataaaatttgactgtgcctgatatgattagtagcatgagtggggatttaaaggatggttaagacatctgaccatcacaaaatcgttaaccgactttagtgactattttttacgaaaggcttgtaatttttaatagcttccgctagtataaatagagcaatagacaccacacatggaggattagctcagttgggagagcgtctgccttacaagcagagggtcacaggttcgagccctgtatcctccataatgaaaacacctaccactgcggcaggtgtttttcttttacctttttgaagttggacggggcgtccaacgcatgagatttgacttagtttaaatagctattagagggggctgattctgacaataaaaacgccactactgattgtggcgacggttgattagccgtgcatgcgcgctagatagagtaacagcgttgcaatgactgggctaaattggtaaaggtagctgggcactttaaatggtcgacgactgttgatgagcgtgacaaggatgacgataccgccgatagctattaagttgagtcgttgtaaccagtaaccgataacgacggtgattgccaacaagaccatatctgtccacttgggaaaatggttggcccataacccgattagtgctggcacatatagtaatgccaagtcgagcaacatatcctgactgagaaaatgcaaacccgcgtaaataagtaagatttggaataaaattgcttggccaaaagcaatggtaccagcccattgcttggtaactttttgtgtgcgcaacaaaaatgtcaacaggagctgaacagcaactaatggtaacaagatccattgattgatggcaccaatgataccggtaatagcggcaatgattagaactaatgggtaacgtttaacgaccattgcagccgctaagcaaacgcccatgagtaaaagcgcgatgatttgaaaatgccatgtgatttgtaaacttagcgcgatcagaaacggataggcgagtatttgtccgataaaggccgctgcaccagcaccttgattgatatttttcaaattgattatcctttctatgatgcttccattttacaaaaccctgagacggtaaacaaagattttcggaaattttacatcttttatgttatgctactagagttgcaaaacattcccgatggggttcgtcaaagctatgacgaacatgccttgtaacctaaaataataagggggaaacaaaacatgcaggaacgccatttatttacgtcggagtctgtttcggaggggcatccggataaaattgctgatcagatcagtgatgctatcttggatgccatgcttgaacaggatcccgattcacgagttgcttgcgaaacgacggtgacaaccggtttggtgctggttgtcggtgagatatcaacaaaggcttacgttgatattcaatcagtggttcgcgggacgattaaaaagatcggctataccaaggaatcaggttttgatcctgatagtgtcggggtgctggtcgctttggatgagcagagtccagatatcgctcaaggggttgacgaaagtcttgaagcccgtgagtctgatactgatccgcttgacaagatcggtgctggcgatcaaggcatgatgttcggttttgccattgacgaaaccgaaaactatatgccgttaccgatttcattggcccacgcgttaatgcgcaaaactgattcattacggcacaagggtgaaattagttatctgcgtccagatgctaaggcgcaggtcacggtggaatatgatgatgatgacaatccaattcgggttgattccgttgttgtctccgtgcaacatgatccggatgtcacgcttgaagaaattcgccgcgatgtcgaggccaagattattcgcactgtgattcctgaagctttaatggatgatgacacgaaaatttatgtcaatccgactggccgctttgtactgggcggtccgcaagccgattctggtttgaccggacgcaaaattatcgttgacacatatggcggttttgcccgacatggtggtggtgccttttctggtaaggacgcgacgaaggttgatcgttcggccagttatgcagcgcgttatattgccaaaaatgtggtagcagcgggtttggcgaaacgggttgaagtacaattggcatacgcaatcggtgttgccaaaccggtttccgtgtcggtgaatacatttggcacaagcgcagtatcagaaaatgtgattgaacaggcaatccgtgagaactttgacttgcggcctgctggcattattaaaatgttagacttgaagcggccgatttatgaacagacggcagcatatggtcattttggacgtacagatgttgatcttccttgggagcacttggaggtgcaggctttgctcaagtaccgagattagcgagaaaagaggcggccttagtcgagaattattctcggctgggtcgttttttcgtgcttatgaggggcttctcaagactaacaacatcgcctggcaactcagaagggatatttatgaagcaaaggaaaaccaatgtcgcactcgtaacggcggcaatttttattggcacatttatgacggcgattgaaggcacgattgtgtcaacggctatgccaaccattatcggcagtttacatggggttcatttaatgaactgggtcttttccatttttctgttgactaatgcgatggcgacgccgatttacggcaaactgagtgacaaaattggtcgcaaaccagtttttctcattggactaaccatatttgtcattggttcgttgctatccggtttgtcacaatccatggaaatgctaattattttccgcgcaattcaaggaattggtgctggggctattatgccagttacgattatcgccgatatttatccattcgaaaaacgagcaaaaatgctcggttttaatggctcgatgtggggaatcgcttcggtaattgcaccgttattgggcggttttatcgttgatcagttaagttggcactggattttctttattaacgtaccgttgggtattttcacgtttggccttgtgtggttctttttgcaggaagatcggcgcagtgtccggcagccgcttgacatgcgcgggacggtttggctgctggtggccttgttggcgatgatgtatggctttcagacattagctgaacccaacggcatctggcagttagttgccatggcaattgtggctacgctgggcttctggcgtttttggcaggcagaacggcgtgcagtcgatccgatcattgacttgaaactatttgaaaatcgtacttttgtgattcataatttgatcgccgctttgatttcggggttcgtgattggatttgaagtctacatggattcaaggaattcgcggcatggatgcttcccttggcggctttgccgtgactcctagttctttgatgtgggtcgttggctcttttgttgctggcaagttattgggccggttccaacctaagccgattctgacaggggccatgatttggctgcttggcggtagtcttgtgctggcattagtgccgcaatcgacaccgtattttgtctttctgctagttgccggcgccttaggattcggctttggtttggtgattacgattactacggtaacagcccaggccgttgtggcgcctgatcaggttggcgtggcaacgagtttcaataccttgtctcgaacgttggggcaaacactgatggtctcggtttatgggattgttttgaatctgcgtctgactcaaggtatcgcggcagatagccggctcaatagcaatatgctcaacgaactgattaatccgcatacggccaaaaatttacccgcagcagtgttgccggcaaattttgtatgaaggtctgcacaacatttactttttctcgattatcattgtggcgttggcgattctagccaatcattttgaagcaaaaagggtgctgacaaaagaaacaatccaggagtcgaatgaagaaagctgaaccaactgaaatatcatacaaaaaaccggattctatttaagaatccggttttttgtacgctgatatcgctctcgtttgccgataaataactgaaattaaaatggactgaccactcgatcggtatgatcttcggcggctgcttttttgacaggttgtttgtacaatttcgctgctttatcggtgacttgcgcaatgacatcgtagtctgggtcattttctaacgggccaaaattgaacactgtctgcgttgcttcgcgcttgatatcttgcaatctagtgctgataaggacatgtagcatatctgctttttgatgtgatcgttcgatttcttcactggctttggctaaggtaatcaagcattgtcttgatcatgacgattaaggtgatgtttgccaaggagtatcgtttattgccattagcgtcatgcctgcgagaatgaatgagctgcttcttttcccagtatcgaatttgcgttggggtggctccggtgacgcggctggtttcgcctatgccgagtgaaatatcgagtgaacgtaaacgtgcattaaacggtcccatgacatagcatcctctcttgaaaatgcgctcactggcgcaaaaacctatgcataaggactgtggtcgtcatgaccaatatccggccatcacggccaagcccacttatgatctggtttctcaacgcgcctgttcacgctattaccttgacatttattaagtttaaatgtaatattttctattgtcaatatcacattgtgtgatataaaaaacatgaaatcttataaagaaactaggcgaagttatggacgttaaagatatcaacgggaaacacgtcaatgtaccaatgatggtcacgaccttgatcgttgggacgtttattacgatttgaatcagaccattctatctaccgcgtttccaacgctgatgaaggccttcaacatttcaactgcgacagtgcagtggttgtcgacaggcttcatgctggtaaacgggattatgattccagtatccgcatatctgagtgcgaaggtgccatcaaaatggttatacatgagtgcgatgagtactttttttgtcggcacattggttgccttcattgcaaatagttttggcgttttgctaattggtcgattgattcaggcgcttggcgttgggatcacgatgccgttgttgcagaacatcatgatgtcgatttttcccccgaaccggcgcggcgctgctatggggatggctggaattgcgattggggtggcacctgccatcgggccaacgctttccggttatgtcatcgacaatttcggctggcgtttcttattcggtatgattctgccaattgccggtctcgttattttggcaacattgtttttcttcaaaaatgtcttaccgttgtcttcctaagttagatattccttccttgattgaatcatcaattgggtttggctccttgctgtatggcttttctgaagtgggcaatgatggttggggcgatccgatcgttttaggcacgatcgcactcggcattgtgtttatcttcatctttggttaccgtcaattgcacttaaaagaaccatttgttgaattgcgagtgtttaagagcaaaatctttgccttatccacagtcttaggtaccatcgccaacatggcgatggtcggggtggaaatgattttgccaatgtatttgcaaatcattcacggcaagagtgctttggagtcaggtttgacattgttgcctggggcgattttgattgctttaatgagcccggtcactggtcaagtgtttgatcgcatcggggccaagcggcttgcacagttaggcttgttcttgctgacgattgcaacactgccatactttttcctgacagaaagcaccccgtccatttttatcacagtgatttagtgcggatgtttgggatttcaatggtcatgatgcctttgacgacgaatgggatgaacgccttatcacctgatatgattcgacatgggacagcggttaacaacactgtccgtcaggtggcaacttccatgacaactgctgtcatgatttcagttctgtcaaacgtcaccaatctggccaaaccggcggccagtttgttgaaaaccaatccgctgcagtataagcaagacttttttggggcaacacttagtggctaccacgcagcctttctgctggcagcagggttcagtttaattggctggatcttggctttcttcttgaatacccacgcgatgtcgcaagaagtgacgatcaaaaatgaaaagaaggtgaaggcatgattctatggtttttgggcctgacagtgatcggcctttatctcagctttattatgatgaaacgctccagtttgcgtagcacgttaattgcggtcttcgggattggtgtggtgggtagtctttacgttgaatgataatgcgcattttggcatggtcaaacgaacaacaactgatgagcagaccatctacaccgcctcaccgaatgcacaactgccaatgttgctaaaacaaaacattggcacggatggcaagcatgttgtctacatttataaaaccgatccgaagaaaaaagcggttcataccaaggctgatattgttgtaactaatcgggtgacaacgacagcgaatgccaccgcttcgttgacgagcaaaacaactcggtggcaatatcaaaacggtttttatggtgcgttgttcaatcatgaaggggctggtcaattggttgctcagcacaatcaattggtcatcccaacaagctggtcagtgctgacaacggctcaggccaagcagcttggtaaaaagttggccgccttgcagcaaccaactgcagagcaaaaagcgtcactggcagccgcagtcaaggctaaagctgctgcgctggtcaaggctgatccaaacggcagatccgacagctttagcgaagcaggctaaggctgcagttgaacaagcaatgattcagcaggctgttcgtgaagtgcaagcacaaaaatagtctgatgccgcccataacgtggtactagggcaaacatttttcgtaacattatcttgacgaatggcttttgtcagccttctaaattaaaaaaagcagaccgctattttttaacggtctgcttttttgattgtttggcaacttggtttgtcagataaggactaaaataccaccaactcaccatcagcaaggcaaagccaagtgaaaatccagcaaagacgtctgtgggatagtgaacgcgcacgaagatccgagaataaccggttaaaagaatcatgctactggcaaggcaggtgatgagccatttggcggattgacgtttgagcagtgcccaagccaaaaggatcatggtaccgtaaaagatcatcgtgccactagaatgcccgctaggaaaactaacagcatgtaccaatgcccgaatctgaggatctgcaataaaaggtcgtggtcgccgaacccaatatttgattccgacgttaacgaggctcatcaaggcccccatgctggctgcaaaaagtgcggcgtaacgataacgcttgagcagtaacaccacggcgaacgccatggttaaaaaaactaaggatactggattgccgagactggtgattaagatgagtaagggtttaaaagtgacaggatggaactggatgacagcggcaattacctgttgatcaatggtatgaatccatccagcgttatttagaatacccgtcaataacgtgatgaaaataaataaagcaattgctgcaagatacaatggttcgggtcggcgttttagcacttgttgcctcctctacaaaacgttcgcagtcgcagaaacctccacataaggacctcagacagaaatggccaaagtccagtcatttctgtctgagtccacttatgttccgaaacgtgcccgctcacgctctgaaatcgactaatgttataagaatagcacaaacaccattgaaccttggcaatgtttttgctatgattgacgcaatcatcaaacgaacaaaggagtagtaagttagcgcgggtgacagagagcaggcggtggtgcgagtctgacgaagcaaagaccgaactgacctttgaagttgctggggtgaaattagtagccacagccggccggaccgttatctcctttgagcgctgtgaaagcagaacttaggtggtaccgcggctgagccgtcctaatgtagatagggcggctttttgtttgaaattaagtgggaggtaacaaaatggcatacgatcatcatgagatcgataagaagtggcagcgttattgggccgagcataacgaatttaataccacaaccgatcctaagaagccgaattattatgcgttggacatgtttccttatccgtcaggccaaggcctgcatgttgggcagggtatacggcaactgatattgttgcacgcatgaaacggatgcaagggttcaatgttcttcatcctatgggctgggatgcattcggcttgccagctgagcaatatgccttgaacacgggtcacaatccgaagacctttaccaaacaaaatattgagacctttaagcgtcaaatcaacagccttggcttttcatatgactggaatcgtgaaatcaacacaacggatccgaattactacaagtggacccagtggatttttgaacaactttataaacatggtctggcatatgaagctgaggtaccggttaactggagtccggatctagggacggttgttgcaaacgaagaagtgattgatggcaaaacggagcgtggcgggttcccagttgttcggaagccgatgcgtcagtggatgctgaaaatcacagcctatgctgaaaagctgttgacggatctggacgatcttgactggccggaatcaattaagcagatgcaacgcctggattggcaaatcaactggggcacagatcaccttccgggtaactgacagtcatgagccgtttgatgtctttaccactcgtccagatacgctgtttggtgcaacgtatgtcgtgatggcaccagaacatgaattagttcagaaaattaccaccccggcacaacaggccgtcgttgatgcgtacattgacgaagccgcccataagtcagatcttgatcgtaccgctttagataaggaaaagactggtgtttggaccggggcctacgcgactaatccggttaacggcgaaaaactaccgatttggatttcagactacgttttagcctcttatgggactggcgcaatcatgtccgtgcctgcgcatgatgatcgtgactacacttttgccaaaaagtttggtattgaaatcaagcctgttattgaaggcggcaatgtcgatgaagcagcttatactggcgatggcgtgcacatcaactccgggttccttgatggttaagcacgacgcgattgatcgaatgatcaaatggcttgaagataaaggtatcggcagtgccaagatcaattacaaactgcgtgattgggtcttttcacgccagcgttattggggtgaaccgattcctgtcattcactgggaagatggcgaaaccacgttggtgccagaagacgaactgcctctcacattacctgaagaggctgatatcaagccaagcggtactggcgagagtccactggcaaatctgactgactgggttaatgtggtcgacaagaacgggcggaaaggtaagcgtgagaccaatacaatgccgcaatgggcagggtcttcatggtacttcctgcggtttgttgatcctcacaacaaggaagctcttgcggattacgacaaacttaaggcatggatgccagttgatctgtacattggaggggctgaacatgctgtgctgcacctgctgtatgcccgtttctggaatctgttcctttatgacatcgggcgatcccgaacaaagaaccgttccaacggctatttaaccaagggatgattctgggcgataatcatgaaaagatgagtaagtccaagggcaatgtggttaatccagatgatgtggttgatgagtatggtgccgataccttgcggctgtacgaaatgtttatggggccgctggatgctggtattgcttggtcaacaaaagggttagctggtgcccgcaagttcttggatcgcgtctggagtgctttcattgatgatgaaggcaaactgcgtgatcggattacaacgatcaatgacggtcgacttgataaggtttacaatgagacggtcaagaaggttaccgaggactacgacgctttgcatttcaacacggcaatttcacagatgatggtcttcatcaactcagcgcgtaaagatgatgacctgccactagaatatgttgaaggattcgtgaaaatgcttgcgccgattgccccgcatctaatggaagagatttggtcacggcatcacgatcatagtctgacttatgcgccatggccaagttatgatgaaagcaaaatcaaaaccgacacttacgatatgatgatccaagtcaatggcaagctgcgcggttcgattacggcggatgtcaacgaatcagatgatgagatcaaacaagcggctttggcaaatgataatgttcagaaatttacggcgggcaaagacattaagaaaattattgtcgtaccgcgaaaaatcgtgaatattgtcgcaaaataaccgcactggcttcaccaattaattgaaagaaaaaatggtcaacgaatggttcctgaaggaagcgggcgttgaccatttttttagcgattcagctgcatgaaaagttttgtatttttggcctttcgattgtgagatcacttgctacgtggcggctggtaattgtcaaagttttcttttgattcccgaaagaagcccgggaaagattgcaagtcgcgctgggattgcctaaaatataaaggattatgcaacacgacaggagtttatcatggagaattcgctgggcagcggtaatcaaccgcaacgttcagataaggaaaaaatgatccgcggctcggcgtggatgactgccggcagtgttttttcgcggattttaggggccatttatgtcattccatggcgtatttggcttggagcagcgtttctaactgccaacgctttgtttacaaaaggttatcaaatttacagtctttttctgattatttcgactgctggtgttcctggtgctgtttccaaacaggttgcccggtacaatgctatgggcgaatataaaaccgggatgcgtcttttttaccacggcacttttgccatggtgctgatggggattgtctcgtgtggtgccatgtggctgctgtcgccgcttttagcagcgggtgacgcgcgcatgataccggtttttcggtcactggcatggccgttgctgctaattccgtcgcttagtttgattcgcgggtttttccaaggttataacgagatggcgccgagtgccatcagtcagtttattgaacaagtggcgcgaattctttatatgttagtgatgacttacgcgattatggtggcgggtaaccacagctatctgagtgcggtgattcactccaccttcgccgcgttcatcggggccgttttcggacttggactgttagttgtttatttcctccggcaaaaaccacggttggatgcgttggttgcccaaagtgctaattccttgcagatcagtgtcaatgagattcttttagatgtggcacggcaggcgattccatttattatcatggattcaacgattaatatttactatattgttgaccagtacacatttaatccaatgatgaaggctttttatctcgttagcgaagatcagcttgaccgtttttatgcgctgtttgccggaaacgctaataaactgattatgatcgttgttagtctggcagttgctatggccattaccgtagtaccattattggcaggtgcgaaaacgcgcggtgatgttgagggattggcccggcaaatcacgaatacactgcagttgttttttatcgtcatgataccttcggcgttggggatggtggcagtcgcgcgcccactgtatgttttgttctatcgggatatggactggttgggcattcgcttgttgcagatttcatcacttttagcgattatgctgggcttgtttacggttttggcagcaattcttcagggattgttcaataaccgtcttgctattcaagagatgctgattggcttggcagttaaagtgattgtacagtggccaatgattttcttcttcaatgtttacggtccggttttgtccacaatgttaggcatgacggtctcgagtctcctaatgctctattcaacgaatcggatgtacaatattcatgtacgccaaaccattcgccgcggcgtcggtattctggccttttccctgatcatgtgcgccgtttgttacctgattgtgaatgcatcaaccttggtgatcaatccgcggagtcagttcggggcagcgttcgtcttgctgattgcagttggggtgggcgttttgatttacgtttatttgattttgaaaacgcgtttggctgatttaatcattggtgagcgaattagtcgacttcgcgatattttacacattcggtgagcttatgcgattagataaatatttgagtcatttacaatttggtagtcgaaaagaagttaaggcacttattcgcgacaagcgggtacgtgtggccggtgatttaatcactgatcctggttacaatgtgttgccgggtatcgcggtcgaggtgaacgatgcccaagcggatgggccgcttgaggtcgattatttgatgaacaaaccggccggggtgattaccgcaacagaagatcctacgcaatcaacggtgctggatctgatccgaccacatgattaccgaccgggtttatatcccgtaggtcgtctggataaagacactactggtctgttgttacttacgaccgatggcaatttaggccatgcactgctttcgcctaatcgtcatattgccaaaacctatgctgcaactttggctaagacattaactgctgacatgaagcagcaactcgaaaccggcattgatttaaaggacttcacaaccgccccggcacaagtcgttgtcttgcccgataccgatggcaaacgcatccagattacactcacggaaggtaagtttcatcaagtcaagcgcatgttgttggcagttgataatgaggtgacggccttgacgcgaattgctatgggaccattgtcattgccagccgatttagctgctggggagtatcgggctttaaccgatgacgaacggactgatttggataatatcactcgttgagcaaccgagcactttgctgtggtgattgtttggctttgtctaagcgagagattttgtttgttacaggagtttaagagagcggccttgattaggcgaaccaagatggctactttgacaaacatgattagaaagggtgcgggtcatggatcaacaacagtacgtctgccccaaatgccaaaacacggcttatgttgccgaccaatttcaagcaactggtggtaatttttcaaaaatcttcgatgttcaaaataaaaaattcgtgactatttcttgtgccagatgcgggtacacagaactttatcgcagtgaaaccagttctggcatgaacattctcgacttccttttgaatggcggctgagaaggcgtaagttcaggttaagaatgatttcaaaaaagcaggtgacccttcagccgtcgttgtggcggaaagggatcacctgtttttgtttgctgcttgttcacaaattggttcgtcattctgaaagctgctttaagtaggtgggcagttcgcgaatgaccatagtcggtaaggcaacataactattcatagctacaatatcagctacacgggaatggacaaaaacggctgcgagagcggctttgtccaatggctggaactggcccgcaaaggcagcaataatgcctgtcagcgtgtcaccagagccgcctgtggccattgccggcccaccggctgtgttttcatagacatcttcatcaacgaaaacatgtgtctgggaacttttcgcgacgatgatacccggtatttttgcggccgctttttggctggcttcaatggtttgggcagccaggggtaagccagataaccgctgccattcaatctggtgaggggtccaaactagttgggcttgcgggtaatctaggtgatgagaggcaacgagagtgatcgctgatccatcaatgatcatgacctgcttggcattgacggcagcaaaaactgttttcaaaatggtaagggctgtaccatcagtgcccagcccagggccaacgacaatgaccgttgcttgccgcacagccgtctcaagttccggcgcggtagcatcgaggatcattgcctcaggtaatcgggcgtgcaacgcatgacggttaaccgggtcagtcgcaacactgaccaacccggcgccagcgtaaacagcagcactggcactcatgatcgcagcaccgccaaagtgggcattaccgccaacaatcagaattttgccgaaactgcctttatacgtatcacgggcccgtggccgaaccacactttgtgcaaattgctctgtcaattgtttcatgacggatttgccgcctcctttaaaacttcccaattagaaaaagttttggtcgtcaattcaggctggccggtcgttaagaatgctttcgcaaacatgacaagcggcgatgcattggcccatgtcaaagtatcaagtggcaaggcgcaggcaccgagcgaatcctggcccataaattgggcaacgcttgtttctagtttaccgccgttaatggatagcgcatagaaaacgcagatgtgctggttgatggtccagtgttggtacttccaaggatagataaaactggttgcccctagttgttgatcaatcgtggctgtcaatccggtttcttcggtgaattcccgcaagacgtcatgttcaagcggttcagggccatcaaggctacccccgggaaggtcgaagcgatgacgataaggacccccatttttcttaatcacgacaagcttgtcgtcaatcgttgcaatcccgtaacaaccaaatgcgcgatgagttttatgtgtcatcaggccacctccattgatcaagggtagcacgctgctgcagggggaacaaattgtaaaaatagttcgtgattttgcttgcgtgccttacctgcttccgttataatcatttatgttgttgccgcgatggcggaactggcagacgcgcagtgttcaggtcgctgtgggatttatcccgtgcaggttcgattcctgttcgcggcattctcgtgatttttaacggcggttaaaaatcgaaatgcccgtgtaacaacgttttagccttcctaattgatgttaggagggctatttttgtgtgcaaaatgtgaacaagcaatgacttatgccttgatgcaagtcatcaggtctggaagctgtgttatattcgtcatgaggcgactgagcaagcggcaaggtgaatgaggagtataaacatgatgtggcctgaaatgaagcacgatcaatagttgaaagggatgatcgctggatgatttattttcttgatgaatacttacttgcaaagaactcaagtgttgaacatgctgcgttgaaacgactggctttgttcaaacaatttaagcaaccagttaagattctgacgcgtgattacgatcgtttgagtgtccaaaccttgcgcgagcttggcgttgctcagacggatgtgcgcaacatgttcgactattttcagcatgtgcccgccgaccgaccggaaaaagctgtgcataatgatgagatcaatttgccgacaatggatgaagtttcagtcgatgctaaccaaagtcaggtcacgaacggcgaccggctgcgacggcaggtcggttatattccaggaaccgtcggccatgtttattatcaaaactttttggacgatcaaggcaatcttgtggaatgcgatctttgggacgcccgagggtttaaatcggccactcagtattttggacaggatggcttgttagcctttgaacgctactataatcttcgaggtgtaccagtgctcgacatttattatgttggtgatcatgctggtcagattcagatcagccggattgttttaaaaggccaaacccttaaagaagatcatgaatttgatacattgggagagttgtttagctattttcttgatcaacttgcgactgaagattcagaaacaacgatttttatcagtgatcgtccggggattggcgttcaaccgctactggcaatgcatgcagccgcaaagaagtttgtttacatacccattaatcatgttttaacacctgacaaaccgcggcaaggcgaacttgatggttttattcaacctgtgctgcagcatccccaaaaagtagatggcttaattgtacaaacgcctcagcagcaacatgatcttcatgatagttttccgaaagttcgggtggcggcgattccagcggtgacatttgatccggctttgacagcgcgctcggcggccgccgctgcaagcaagaaaatcctgtttgtgggtcggctgtcgcctgataagcaacttgatcagctacttcgggcagtcgctttggcgagtcggcaggtgtctggcgtgacgcttgatttgtttggttacggtgatgaacaatatcaaaccgcgatgaggcagcttgcggatcgtttagagattggcagtcaagtgacatttaagggttaccagtcatctttggctgatcagtacccgcaatatgccttgttggtcaatacgaatttgacagatggtggtccgttggcgttggttgaagcacaaacccatggactgccagtggtgagttatcggttttcctatggacctagtgcctgtgtgattgatcagaaaaccggttatcttatcaagcaaggacgcgtcaatgaccttgctgaagcgattgtgagactgctaaagcggccagagcagtcacaacaattcggcgatcatgccagagcactggcgcaaaagcagctagcgcctgaaaaagtctacgcccgctggcaagcatttcttggactggacagttaacccgacaaaacggcaaggaggttcaggatgtattattttttaaatgatcaaatggcctatgccaagtctggtattgaaggcgcggaaattcagcggttgcagcttttcaaagcgaaccagacgccagcaaagattgttacccggcaatttgctttagatctacacgatgttttgaaagatgcaggcattgacgatactgattttatcaatctgtttgattacttttgtgacctgctgagcacaccgtggcagcaggtaacggttgcagacgtttgccagccgactgcgggcgtgacccgccggcgtgaaggacgccaggtgatcttcagccgcggttcccgagtcattcgaattgtttatttgcgcgaaaaggcggggcgtgagcaagaggttagcaatgttcaatactttgatgtgaccggccgaacgatcaaaatgagttggtgggacacgcgaggcaaccattgtttggatcagtattttgatcaaggcggcaaaattttccaagaacactatttggatcgtcatggtcgcacgcggcttgaaaaactgcattatttaaatcatagccagcaagaaaaattttcatggaaattggttgattttcatggtgtggattatctatttgatgggcttcatgatttgacaaggttcttctatgatcacctgaatcaggtagatggcggctataatgtcttcgtgtgcgatcggacgacggaaactggctggggcttgttgcacatgacgacaccggcgctcaaagttttgcatctgcataataaccatgttgccgggaataaggacgtgctgcatgcgaagctgaacaatttttatgctagtgccttgacccatttgaatcgctgggacgctgtgattgtgccgacaccgcagcaggcgcaggatatggctgcccggtttggcacagccacgccgattttcacgattcgagttgcttttgttaaggcggcagatgtagcggctaatcgcctcccgttttcacaacgcgaacaacatctggtggtgcatgttgcacgattggcaccggaaaaacagcaagcaagttcaattcgggcatttgcccaagttgtgaaggccattccggatgctaaacttgaactctggggttatgccaatggtgacatggcgccgaaactacatgctctggttgaaaagctgcatctcgcggatcacgttttctttaagggttatactcgcgacatagcggccgtctataatcgcgcacagttaggactgttgccttccagtgccgaaggatttccgctaaccttgatcgaagcacaggcacacggattaccgatgatcgcaaatgacattcactatgggccagccgatattttggccaacggtaaaagcgggcttttgacgcaaaatggtgacattgatggtttagcaaatgcgatcattgggttattgaatgattcaactaagctggcccagtttagcgcggctgcctatgacaatgctttgcgattcactgatacgagcacatttgttcagtggcagaaactcatggcgtttgcggcaaagaaaaagacaaggctggcggcctttgagcatgttgattaggcaccggtcatggcaatgagtggcgtttttactgataactgttcaaaaaatggtaggatgaggcgtaagcttttaccaagaaatggaggctaaccaatgtcaatttatgattatgaggtcacattagaagatggttcgcaatatgctttgagcaaatacaagggtcgaccaatgttgatcgtgaacactgccactaaatgcggcttcgcgcctcagtttgatggtttggagaaattgtatgacaagttcaaggatcaaggtttggtagtgctaggttttccttctgatcaatttaaacaggaactggctgatggtcatgcggcggccgaggcttgccggttgaaatacggtgtgagttttccaatgcatgatttgattaaggtgaatggcaaagaagcagctccgctgtttcaataccttaaaacccaagcccctggtgaactaggcaagtccatcaaatggaactttacgaagtttttggttgatcgtgatggtcaagttgtcgcccgctttgcaccaaaaacaaaaccagaagcgattgaaccagcagtggagaagcttcttggctaacttttgtcagttgcacgtggggctggttcacgctctgttttaaacgcgtttgccagcccagagacctgcgtgtaaggaccttgggtgcaatgaccaaagcccggccatcacacccaaggccgcttacactccggtctctcccgggctggttcacgctctgttttaaacgcgttcgccagcccagagacctgcgtgtaaggaccttgggtgcaatgaccaaagtccggccattacacccaaggccgcttacactccggtctctcccgggctggttcacgctctgttttaaacgcgttcgcaggcccagaaacctgcacataaggacctcggacataaatggccaaaatccagccatttatgtccgaggccacttatgctccggtttctaaccgggcctgctcacgctctggacactcatgcatgtgatgcgtacaatgacatcaaaagtaagaaagcagggatgattgatggaagaattgccagctgatgtagcggcttttgttgaaacacatttggttgatcggcgcaatagtaacgccgtgaagtgggatggtttggcaggtgaatttggccgcacggatctcctgccgatgtggattgccgataccgaatttaaagcacctcaggcggtgattgacgccttaaccgctcgcattcaagaaggaacttttggctattccattcggccacaatcctactatgatgccttcattgattgggaaaagactcgccatggcgtgacggtgcagccggaatggatgcgttttggtgtcggtgtggttaaatcgctgtatgccatggtcaattggctgaccgaacccggcgatccagttttaatcatgcagcctgtctattatcccttcatgaatgcgattaaggatcttggtcgcaaagtggtctcggttgatcttcaattaactgctgatggctggcggatagattttgatcaattggagaaaacgctggcgacgcaaaacattaaagccatgattttttgctcgccacataatccggtcggccgagtttggacccgtgaagaactggaacggctttttgcgatcacgagtcaccatgatgtcacggtggtatctgatgagattcacggcgatttggaagttagtgggccaaaattcacctctgctttgcaagtagctgagggtccggcgcgcagtcggcttgtcgtcctgaatgcaccgtcgaagacctttaatcttgcggctttactgaattcgcatattattattccgaatgaaaagttgcgcacagcttatgatgatttcatcaaacagttgcatccagtagataccagccttttgggacaggtcgccggtgaggcagcttatcgtcacggtggcgcgtggttagacaaggtgcttcaagttgtccgatataactaccaacagttgctaaccggtctgaagcagagcgctccgaaggctacagttgcggacttgcagggcacctatcttgcctatgtggatattggtgcctatgttgcgccagccaaaattaaatcatttgttgaagatgtttgcggactggcagttgattacggcgcatggttctccccaaaaacagctacgtatattcgcttgaacttagccaccgaccccaaacttgttgccgaggcgattcagcgtttaactgagcacttggctcagccgcaactttaattgaaacagaaaaaaacaccctgttaacgcaaggcaggttgactcattaccaaacatacaaggtttggtgctgagacagcgacgcttgctgatggcagggtgtttttttgtgagtagtcttagttaacagtcactaagggtgattgatgattaaatgattatcattcatattatgatcctgtacgatttctttaagatatcgccgcagcattggtgagcgttccaaaacggcccaacccggatcggcttttaatcgcttgagttcagctttatcgggatgatcatcgcctgtgaaaaagcgccagttcaagacacccatcagttttgcggcagcatccaaatcatgctgattcgtcacgccattatccatgagatccccatatgcaaggccttcgccatcttggagaaagagttgcttcagataccgttgataatgtagcagatcaggattttttcgttgcttggcggttaagtaaggtgtgggatcagtcgcatgcttttgataggtgattcggttaggcgtgaacgtcaccaccccataactggcagggctgatcgaaaatgcgccgctgacaacttcaatcgttggacattgcccatccggatcgcggctgatgtcttgcgcatggatgtgtccggaaaaaagcaacggaacatggtaagctttcagcaacgttttgagttgatcgctgttgtccaaaacaaatccttgattcaccgcttcattgtgggcatatagattgtggtgcatgaaaacaatcgacttgcgatgggccttttgaccagcagctaattgctggcgaacccatttcatggtctgcggtgtgagcttaccaccagtgttcggggggcgattggaaggttcgatcgtataaatattgctgtccagcatcagcaattgataattgcggttaaggttgacgcgatagctcaaactattcggatcctgcgcaactgcctgctcataactggtatgaaaaatattgcgccaatcgctagggctgatttgttctgtcagtagttgtcgtttgcccttgtaggctcgtgcccaaccatcgtaaatatcatgattgccagggatgatcaacaccttcgtaccattggcaacaagtggttgtaggcggcgcatgatactttcggcactggctttttcgccgttgaacgtgacatcaccggtgatgacgagggctgtcgggcgggcttttaaggcgttttgaaccaaagcattgatagcaacgggctgatagtccatatcttttcctgctgcagaacgtttgatttgggtataagcagtcttttcatcatgtagacttggggcaataaagtgggtatcgctgagcacccaaatggttgcctgtgaactattggtgagtgggcgatcacgattagggtgaatttgccccaagacgattgcaaagatcagcattaaaaataacgctgctacatatttgactgctttcattttctgcctccgtacctagtttaccattgatcaacgtaacaccagcaggtcattttgagtggttgtcaaaaaatttttttgatgattaacttgttggtgacttaaaaacgttactgaccgagagcgggattatggtaaaataaagccacatttgaccacgatagcgtttagagagaggacatatacacctatgcaagtaatcgtaacggttatcggtaccgacaaagttgggatcatcgcacaagtaaccactgctttagcagatttagatgttaatattttggatgtttcacagactatcatgcaaggtgcatttacgatgatgctgctagctaaaattccagataatggcaatttcaatacggtaaaaagtcaattggcgaccttgggtgatcaaattggcgttgagatcaaagtagcccgtcaagagatttttgatgccatgcatcggctttaatatgcgttggatcggcaatcgtacttatcagagctaaaggagccagtgatggaaactcaacaaattaaagaaaccattgaaatgatcagtgaagagaatctggatatccgaacgattaccatggggatttccttgttggattgtgtaactggtgacctgcaaaccacagccgacaaagtatatgccaaaattatggcaaaagctgccaatctggtgccggtagctgacgccattagcgacgaatacggaattccaattgtcaacaaacgtattagcgtgaccccggtcagcttgctagctggcgcggatcaaaacctcgattttcgcccgattgcccaagcgatggatcgagctgcaaaagatttaggtgtggatttaattgggggctataccgctctcgttcaaaacggtagtacgccagcagaaactgcattgatgaagagtttgccggaggtgttagacaccacggaacgcgtttgtgcgtccgtgaacatcggcagtacacgcagcggtttgaacatggacgctgttaagttgatgggcacgatcgtcaaagaggttgccatgcgcaagccgcagaatgcgatgaaactggtggtattctgcaatgctgttgaagacaatccgtttatggcaggtgctttttgggggatttcagaaggtgatgttgccatcaacacaggtgtttccggtcccggggttgtagaacgggcgatcgcggccaaaccggcggcaagttttgaagagatctgtgaaacgattaaacaaaccgcctttaaagtgtcacggatgggccaatttgtcggtaaagttgctgcggatcgccttgatgtaccgtttaacattgttgacctcagtttggcaccaacaccggcaaaaggtgactcagtggcgcaaattctggaaacaatgggactcagtcatgttggcacaccaggcacaacggcagcgttggcgttgctaaacgatgcagtcaaaaaaggcggcatcatggcggctgaacgtgtcggcggattatcaggtgccttcattccggtttctgaggatgctaatatgatcaccgcagcggccaagggtcaaatcagtctggaaaaactagaagcgatgacggcggtttgttcggttggcttggatatggttgcggtgcctggcgacactcctgacgccacgattagcggcatgatcgccgacgaggctgctatcgggatgattaacaacaagacgacggcagtcagagtgattccagttcctggtaagcaggtgggggataccgttgaattcggcggtattttcggtactgcgccgatcatggcaattaacgatggcgatgcgcagcagtttattaatcgtggtggtcgtatcccagccccgatccatagctttaagaactaacgcgtctcatttttaaacgattcgacttaggccttgttgttgctggtaattgccagtagcagcagggctttttggtggcggtgcgtaatgttttgatgaggtgaatcgtatgtttgtagccctagataaaaacaatcaacgtgtcacattgacaagtcatgcccaggcggccaatttaacacaccaaacctttcactgtcctatttgcaagcaggtcgttcgcatcaaaaacggaaccgtaatgcctgcccattttgctcaccgaagtcaaccaatgggtgagggtgaaccagagagtatagagcacctaactggcaaatggtggttggcgtcttggctcaaacagcatggcgaacaggcaacgttggaatactatgatgcaaccattcgccagcgcgcagatcttttggttgcaagtaaaccgccgagggtagcgggtgcaaccgtggatgacgctgcaagcagctgcttatcaacagggccgcaatttgaatggctccccatggttcgttcacagtcggccccatgtgttacggcattttggtattccggaactccaactgcgactcaaatggctgttgatctttgaaggacagccttttaccgcgactgccaaccgtcaattttggcaagcggccctgccgaatatctggacgcctttgttgccagctggcacgctcgggaaaatgatgggtgcccactggctgcaagtgttgctggcagaaggcttcgttgttcaggaagatggttgtcgttatcagtggcagcgtttgcctgtttggtttgccgatcttgagcgaaaattggccatgaaaaaagactttgcttaaggcaaagtctgatgaggctgattgcttatcatgattcgcaaggtgggaaaatgtgacggtttgtgcgcttatggaaacgtgtttgtagacccagaaaccggcatgtaaggacgctgaatacaatgcctgaagaccggtcatcacttcaggccactgataggccggtttctagccgagtctgttcacgctctaaaaaattctaaagttactccccatgttttctggccgttcggtgaagaaaccggcgggatctgttcgtatgagatcgcaaagatgtgggatgagtgctgggtcaccgatttgttcgatcaaaacagcatggccgtcatctactttgcgatcggtgtcaacaatgacaagggaaggcgtttgagtgatacccatttggttagcagttcgttgatcggagtcaaagcccattttaacttcggaacgctgacgatcttcataaaacatttcctgatccagcttacatttgtcgagcatctttgccacaaaggccgcatcatattggtattgaaccagaggtgcgtgttgttgtagccgcaacaagagcatccgtgcttttttgttgccttgatattgtgcagccttataatccaacgcaaggttgtaagctgcacggagcagctggttgcgtttagcaagattacctacgctcagttgctcacgtttcataaattgttccatgatatctaaattaagaacgggaacgaagtggacgcgcacttcctgctggaatttatccaattgtctgagtaatttctgttcagtacccagacagacgctcccgattggattgaaaaaaaggaaaatttctatcacgttaacggcctccaattcgccaacaacaaattcttacatttactttatcagaaaatgagcagggtacaattaatcagcttgtgaatcgtgcacatgcatgaatgcgcgctgaactttgttgataaccggccgtttttcaatgttgaattggtgcaacaaagtatcgtagaaaacttgagcttgtggcaggtcatggtactccatttccaactcaaaatcagaggtgttgtccatgtaaaaagtctgatcgagtgtcaacaaacctgctttaagatgcgctacactgcgggtcgtttttgcttgggtttgcggatgaaccgctgcggggtcaatttcacgggctgctagtgccgttgtgacttgaccggttttaagttgcccttggtcaatcaaggagcgggcttcaactgaagtcagcggatcggtaatttcttccaaatcacgatgttgattcttattaggaacttttaaggtttgttccgcacgatctttaaactgacgaatgcgcaagcctaggcctgcctttttgacggcgccagtcggtgtatcgtaataggtattcatttgactgaagcccggctcaaaatcaaactgattgagaatcgctagaaaatcagtctttgttaaagttgttttaaattcctgttcgcgagaaattgacatgaactgcctccaaagacaaagggcaacggtgacgagacaaaaatatgatagaatggtggtcgtgagtgacttggctggcaagaaagctacgggttgccgtacttcttaaccagtctggctggaatatagccgtcgtttgtcggccaagcctcacgcaacgtatcatcagtagtttagtatgggagggccagcaatgcaaagggactgggatagtttcttaatgccgtatgaacaagcagtcggggaattgaaaattaaatttcgcggtatgcgtaaacaatttcaacaggccaatgaacacacacccatcgaatttgtgacggggcgggttaaaccggtcagttcgattattgaaaaacaaagtcggcgttttatcagtgacgaacttttggaacaggatatgcaggacattgctggtctgcgaatcatgtgtcagtttgttgaagacatttatcaagtcgtggcactccttcgtcaacgcacagacatgaacatcgtggaagaacgcgattacgtgaccaacgtgaagccttctggttaccgcagttaccatgtggtgattgaatatccagtgcaactcatccatggtgaaaaaaagattttggcggaagtccagattcgaaccatgtccatgaacttctgggcaacgattgagcacagcctgaattacaaatataatggcgaatttccggatactttgaaggcgcggctcaagcgggcagcggaggcttcctttatgttggataaagagatgtcagatattcgtgaagaaattcaagaagcccagcatctgtttgtttatggtaaagggcagcagccacattcgaaaacaaaggatcaccatgacgataaaaaggatgagtaagatgcgtgtgacagttttccataatagcatacctgcctcaatcacggctgcgcaaaagctgacgaagcttttgaagagcggtcactttgagcttgatgagcggcatcccgaggtggtcgttaccatcggtggtgatggtacgctcctttcggcctttcatcgctatgcggatcagttaaactcaattcgcttcatcggtgtgcatacaggccatttgggtttttacacagactggcgggattttgaaattgaagatttagttatcgccttaaaagaagactctggacaaagcgttagctacccacttttggatgttcaggcgacttatgctgacgcgaccagtgctcattatctagcattgaatgagtcaaccttgaagcgtttaaacggtactatgcggacggaagtctatatcaaaggcgatttctttgagagcttccgcggggatggtttgtgtgtgtcgacgccaactggatccacagcttacagtaagtctaacggcggtgctgtgattcatccgcgattggatgcgttgcaaatgaccgaaattgcgtccattaataatcgggtttttcgtaccctcagttcgccgattatcacggcaccagacgagtgggtgacattggagccgacaggtcgcgatgattacgtcatgactgtggatcagttcgtcatcaatccaccaacaatcaaacaaattcggtataaaattgcgaaagaacggattcattttgcacgctaccggcatatgcatttttgggatcgtgttgaagacgcctttatcggagccaaacactgatgcgatttgaatggcagtatgagggaccgccgctgaaattggcggcttttttaaaacaacagggtttttcccgtgcacagcttaagaaacttcgttatcaaggcggatttgtttttgtcaacaaacggcaacggcataccgcttatccggtgcgctcgggggacagaattttggtacagacagcacctgagcacgcggcagacagtgtggtgccttattcgcatgatttggccatcagttacgaggatgacgattatctgatagtgaataaaccggccggggtggcatctattccagcggttgggcgccaaaataatagcatggcgaatatggtcaaggcttatttaattaaaaccaaagctgaaagtcaggccgttcatgtggtgacacggttggatcgcgataccagcgggttgatggtctttgccaagcatgggttggcgcacagcttgttggatcagcaattgcacagtcaagactttgtcaaacagtatgtggcaattgtaaccgcacaaacacctttagcaactcatggttggatcgtattgcccattggcgttagtgacggcttttatatgcgtcgtgttgtaaccgatactggcaaagcttctgtcacggagtatcgaacacttgaccaaaatacggctggggccatgatgcttgtcacgttgcataccgggcggactcatcaaattcgggttcattttgccgcgattggtcatgcgttgtatggtgatggcttatacagtcctgatacgcacggctttaatcgacaagcacttcattgtgcccatttgcgtttctggcagccgttgaagcataaactgattgatttacatgcaccacttccggctgatatggcaacgttagcggcgaagttgagattatcgcaacaagattgagccgccgcacaagtttaaacaaggtatgacaaaagccagttcccgaaaattaggaactggcttttaacatactatgattcaggaacataattagcggcttcaagcgaactagaagttgcctttgtgataacctgaatcggcatcaaacttgaattgttttttgaggccattggttaaatagatcttcttgtcattggtaatgaaaattgcttgaatatgatcgctgtttttggcattcatgtattgcagaccgccttttaatcccttatcaaaggcagcattggataaggcatcgccatcaacactatttttcgagacaatcgtgactgaggccaagttgttgtcatagggatagccagtctgaggatcgaaaagataaatgtatttatggccattggagattaggtattgctcataggtgccagctgtcacaatggattcgttgctttcaggaatcgtacccactgcagtgccacgcggcgcggtcgggtcttgaatcccaacatgccaatcgcgattggtaccaagcggtgagtgacccatgacaacgacattaccgccaagatcaataatcgctgctgtgacgccatctttggcgagcacggccttcactttgtcagcaacccagcccttggcaatcccgccaaaatcaagccgcatcccttttttggtcagataggcggtattatttttggtatcgagtttgacatcgcgccagttgaccagtggcaaggccttgtcgatctcactttgtgccgggacgcgcgcgccaggcaggccaatttgccacagattggtgacggctccaatggccatgtcgaaactgccattcgagttttttgaaaagtagtaggctttttcaagtaagggcataaaatctttaggcactttgaccggcttgattccggcattatcgttgatcttatccaaaaccgaaccgccgcgggttaacgttgcctcggcgtcgacgtgatgaatcatggcaaatccgtcttttaaggcggattttttacctttatcataaattgtcaaagtacaagtggtgcccatgacaaattcattttgtgtgtatggggttttcaagtaagttggactggctgttttttgacagccggacaaagttagaaaaccaataaaagcaagtaaaccgatgacgaattttcgcatgttacataaccctcatttcatctttccctttgaatatcataccgcgcgttatggaaaaagaaagccctggttgtcgctcgtcaagcgtatggcagcaaaaaaggctagttattcaagcggttgcccgcataactagcctttccgtggcgtggttcattagaacgcgattagttttgtaccatgtaaagctttcacacctaatgtctcaccgattgaagcagcgttttgactggtgatcccgccgcctggcaagatgctgattttatcacctgcatagttgatgatggcttgcaggcgtggcaaagtgtcggtgatgggggtggtcaaaggaccgccgtgggtcaagatacgctcgacatcgtgatcggccaaccaatcaattgcggcaaactgcttggtttctggaatggcatcgaaagccatgtggaaaacaacggtcatgccagcactggcagcaatgaggctggtcatcgcgtcttcatcaattgcgccatctggtgtcaaagcaccaaaggcaacgccatccacgccaagcgcctgtgcctcaaaaagatcagcttccatgatttttaattcaacatcgttataaacaaagttaccgccacgtggacgaatcatggtgatgaggctacggccatgttcatgaacatattttgtactctctgccataacgcccttagacacagttgtgccaccaaccgctaaattgtcattgagctcaatccgatcagccccggccgcgattgctttaggaatcgatgtataattttcaactgcaatttcttttaacatgacggacctccatttactagcttagataaacatgaccaataagacaatcgcacctaaagcgattcggtaccagccaaacggtttgaagtcatgcgtttgaacaaatttcaacagccacttgatggcaacgatggcgacgaggaaagaaacaatggaacctgtcatcaaaacagcccattgttcaccagagaagccgttgccttgccacaggtatttgccgattttaagaatcgacacgccaaccatggtcggtattgccagaaagaaggaaaattcggtggcaacgtagcgagaagtcccgattagtaaggcgcctagaattgtggcgccagatcgtgatgtaccaggaacgatagacaagacttggaaaagaccaatcagtaaggccgtttgataagtgatgtctgccagagtggtgatatgcgcgtttttattcttgaggtagttttctagaatgatgaacagcaccccataaatgatcagggttgttgcgactacgagtggtgtatgtaaatgttcatccatccagttgttaagcgggaggccaacaacgactgacggcagaactgcaatgataacttttgcccacagttgccaagttgcgttgcgggctttggctgtcggcttggaaaagggattcagcttattgaaataaagcaatatgacggcgagaatagcgccaaactgaatcacgtactcgaacatattaatgaaatcctgactctgcgataatttaatgacgtggtttaccagatcaatatggccggttgaactaatcggcagaaactccgttaacccttcaacgataccgatgatcacggccttgataatgtcaaacataataaccctccaattctcaatgttaacagtatacaaggttttgcaaggcttgccacgttcaactcggaatttatagtcatcttacgtaattcagcaacttttttgggatgtaaaaaaagcccaaccaccaagcaaaacaggtcttggggctgagccaataaaaagttgtatcgatagttaaacataagacaaacggtttaacttacttagccgataaaaataaaacgttaacggcttctggcgtcggaatatcacgttgaatttcggtcaagagtcccgttttggcatcgcgactatagagtgtgccattactactgttttggttgaccacgagaataaagtgttcagtgagatcgaaattgaaatcacgaggaaaatcgcctgccgtactgatttgttgcaattctgacagatttcggccatccggactgacggcaaaaacggtgatactattatgaccgcggttggatacataaaggaagcgttgatcactgctcagtcgaatcgcagcagcaccattgtgatcggtgtaatcttctggaatggtcggcaacgttgcaatgagtttgaattgaccagttgccgcatcataatttaggatgctaacctgacttgaaagctcacctagtaaataggcaatcgggttgttgtggttaaaagccaaatggcgagggccaaagccaggttcggtgtgaaaaataaccggatcgctgagtttgccggcatcgctgactgcataggttgttaaggtatcattacccagatcaacgaccgctagtcgctgaaagtcaggggtgacagcagcaaaatgaacatgggcactatcttgttccggtcgcggaccgttaccggtatgcttcacttcatccgttaaagccaaaccatgatcatttttaatgcgatagacattgattcggccttcgtggtaattgctggcataaaccagctgacgattcgcatcaatcgagatatgcgccggggatgaacctgcctgcagtaccttgttgatcaagcgcggtggatcaacatttaggtcataagccgcgacaccgccttgatcaccttctgcgtctaccgcatataaaatattgtcatcagatacggctaagtaggtcggtgaacccaaatcagtaatgaatggggcaggggtcggcaaatgcgtttcgtcattatcaaatgtaccggcataaacgcctgcaccgccgtgacgcgtataaccgcctaacaagagtctttgcttcatgttcaagttgctcctttcgaatttgatttgagtatagcatgtttggctgatgcttatgctatgatataaagcgtgagtcaacgtttaatgaaaatagctggccaataaagctatcattaaaggaattttcagacctttaatcaaacgatttgccacagcccataactcagcgccatcatgggccttaacgagatcgcatttatgttggcagcgaagctcagataacaaacacttatgatattaaaaatgacaggcaaacggaggcacgaccatgcaattgacagcaacagtaacagctattggtaaggatgcattgagttccaaggatccgatgattattctctttggaccgcaagcaacagacgcactacgcgacgtcgcggtgatccagcagttcgctgacaagtcagctttggaaaaactggttatcaaggaaggcgaccaattaacaatcgatgatgagacgtttgagatgacttatgtcggtcaacttgctaacagtaacctgaaggcgattgggcacgttaccctgttgttccaagctgtaccagcagacaagccgatgcaaaacgcaatttatttaaaaccgacccatcgaccaacatttaaggttgggacgacactaacttacatcacgcaagccaattaaatgtgacaacgagttcttggatcagttatgcgccagtttctaaccgcttctgcttacggtcaacaaaaaagaagatttcaggcgatctatcagcctgaaatcttctttttttaccatgatgccttacgaacacctggaatttgacccttatgcgctagatcacggaaattcaaacgagacattttgaatttgcgcatgtacgcatgcggccgaccatcaagttcatcgcgactgtgcgcgcgaacgggtgaggcattccgcggtaaagcttgcaaggcagcgtaattatgctcagccttgtacttggcacgcaacggggcatatttagcaatcgttgcttcgatcttcttttccttggcaatctttgactttttagccatgtatgcaatcactccttatttgtggtttgtatttaacgttttttaacgacgtgtctgttcgaacagttcaacccacatagcatagcacagccttaagccgctcgcaacacttacaaaaaataagcgtttaatattgatcgccattgaaaatcgagtttttaacaatgacataatcgaccttggtcaaggactcgagatcgcggccaccggcgtaggagacagctgactgcaagtcttcttgcatttcctttaacgtgtcaccaatcttgcctttgacaggtaacaagatctttttgccttcaacgttgtggtgggtgcccttttgatactcggacgctgaaccgtaatattcctgatattccttgccgtcaatgttgacgtgcttgccaggtgtttcttcatggccagcaaaaagggaaccaatcatgcacatggtggcgccaaagcggattgacttggcgatgtcaccattattgcgaatgccgccatcagcaatgatgggtttacgggctgctttggcgcaccaacgaacagcagctaattgccagccgcccgtaccaaaaccggtttttaatttggtgatgcagaccttgccaggaccgatgccgactttggtagcatcggcaccagcgttttcaagttcccggacagcttctggggtgccgacattaccggcaatcacaaaggcatttggcaaataatgtttgatatgttgaatcatgtcaatgaccacctgagcataaccgtgcgcaatatcaatggtgatatagtcaggagtcagctcattagcagccagtgcttcgataaaatcgaactcgtcatccttgacgccgacactgattgaagcgattaagccgcgctttttcatatcgcgaacaaaatccatccggcgttccggctggaagcgatgcataatatagaagtaatcgtgctctgccaaccagatcgccaaaggttcatcgatgatggtttgcatattagcgggaacgactggaatcttgaaagtatgcgggccaaatttcacgctggtatcaacctctttacgtgattgcaccacacacttgttaggaatcatttgaatgtcttcgtaatcaaaaatctgcatgccgttgttcatcggattcatcctttcgcaaaagccgaacattgttaagcattattggtgttattcaaaacaccaagtgctaagatacgcgaaagttttgtaaaagtcaatcaaaagcacatatattcttttttaatgttcgtgttttgcgaaatggaaagaaaagccggttgcccggcttagaaaaacgacagtggtaattgatgcgacaaacgaggatgtgacgcgtcacagaaggctcagaaaaacttgttgcgccaaaattgaaaggcaagtaccaccgcaatggcaacggaaatggcaatggtgataatccagctcaccttcatatcagccaaagggagatgaacattcatcccgtaaaacgagaagaccaaagtgggaatggttaacaaaattgaataagaagttaggaacttcatgacgccgttcatgttattgttaataattgacgagtaggtgtccgccgtttcgttaataatagaattgctaatttgtgccatttcgatggcttgttgattttcgatgatggtgtcttccagaaagtcttggtcgtcttcatccaaaccaagaggattgctgcgttttaattgttcgaggacgttgcggtcggtccgcaaactcatcataaaataaaccagtgaccgttgaatgcccatcaagccgtagagttcttcgttgcggaggctgcgttgcagtttattttcattggcttcgcgtgccttgtttagatcacgtaggtaggttaggtaactgattgaaatctggtaaaggaactgcagcacggaccgattttgtcggcgagggtcgaagttactgactttaccttctgcaaaaagactgaggagtggaatcggctcgccgttgatggtgatcaccgcggtattagtgatgatgatcgctagcggagccgtttcgtacaccacctttttacgtgcgtcccgtgtgacgatgggcatgtcgaaaataaacagatggctatcattatcttcgtcgtattcgtaacgggcgccttcatcgggatcaaggccgtacaaaaggaaagcttctgagagcttagctttgtcctgtagttgctgacgttctgcaggagtaggatcaaccacattgatccagacccctggactgatgcgggattgctggttcagttgaccggttttgtcatcaaatcgataaattgcaagcatagcgggctccttggctttttcttttagtttacaacaagcaacagcaggatgcaggagggaaacacatgcgtaagcgtgaaacaaaaattcatttggccgcagcacaagcaccgctttttgcttgtccagtctgtggccaaccattacaggtgacagcgggatcgttggtttgtgtcaacggacatgtacgcgatttcagccacaaagggacgctgaacttcctgaatcagcaagtagccaccgaatacacgacgccgatgttagccgcacgacggcgaatgttgaacgctggtttgttcaccccatttttggcagctatggcagccaaacttccgaaacatcaacgactgttagatgtcggctgcggggaaggcacgccgactgcgtatttggccgaggcgggtcaacaaactgccgtgggttttgatatctcatcaccggcgatcaatctagcaggcggcttagcggcaccagttctgtttgcggttgcggatctggcccacctgcctttcgttaacgatgcatttgataccgtgaccgacatcttttcgccaggtaattatcgtgaattcagacgtgtgctgcgtcctgatggtcagctattgaaaattattccgcgggcgggttatcttcgagaaatccgggaaggcttatactcggggacggctaaggctgtgtataacaatgagcctgtcttaaaaaggttcttagcagctttccctgatgcgagtcaggagacaatcacctacgattttccgttagcgccaactcaatttggcgatttaatggccatgaccccgttaacgtggcaggcgcccgccgatcaacgcgaccaaatgcttgctgcaccgccgattagtatccatattgatgttgatttgctcactgtgtcgcatcttgtcaagtaaaagggttgtaaacatcgatggctggtgttaatattcctttaagctatttatttttaacttttatcagggctagcttttgggtaattgataaaagtttgcgataaattacttcactaacgtatcgcttcgctgagtgcgctccgaagcaatgcgtttttttcttgcttatttttacaaattgacctgtccacaaggcctgttcgtgcaagttaaatgtgctaaacttaaaccacttgcgttgaagggaagataacatggcgaatcacattgttttatttgaaccgctgattccggcaaataccgggaacattgccagaacctgtgcagcaacgaatagctatttgcatctcatcaagccactgggatttgagacagatgataagcatctgcgtcgtgcaggtctggattattggcaacgcgtccggatcatctatcatgatagtctggatgacttcatggcaaccgttaaggaaccgcaacacctttaccttattactaagtttgctgatcagacatactcagaccgagattatgccgacattgatcaggatcattatttcctttttggcaaagagacgacgggattaccggaaggcttcatgcgcgatcatgtcgatcagtgcttacgtattcccatgactgacaacgtccgcgcgttgaacttgtcaaattgcgcagcattggtcatttatgaagctttacgccagcagcattttgcaggacttgaaacatcacatacgtacgagcacgacaaattaaagtaacccaacaatagaagtgtgcgagctggctcgagtagaaactggcgtgtgaatggctttgaccgttatggaaaaggacgcttacaagaaggtttctcggttggcaagcgcgtttaggaggctgtatttatggaaacaaaacgttaccctatcgcggttgaatcttttcactatgatttggttaagcaaggaacaccggttaagaacgacttgcaagttgccatgcgccagattgaatggtcagatcccgctaaacaagatgagttgaaaaaaggcaatctttttcagatgatgattccatttgacgttgtccctgacgatgccggttttgagatttctggcaaaattacccagatcgtgcaggttttggattattttggtgaggcaaatgaattgccgcaagccgaacttggcaaactaagccgaccattggttgaaaccattgaaacgttgacttaccaagtgaccgcagttgccttggatcaaggggttaaccttcagtttggtgccagtgatgaacagccgggccaaacaaaataagacaaagttgagtcatgatgaaaggcggccgttatcagccgcttttttgatgagcgcgaatgcattctgacgacaggcgttgtcttttagctcaatgatcgctgaatcatcatggctttttatttgcgagttcagctcgtgtataataggcgggtatgaaaggagcatcacgatggcacagaaacgcagcggacgcaaaagcccgcgcagaaaacgacctaccaaacaacaacagcacacccttagttgggtcggtgcgttatttgtggtgttcgccagcttggcatttttccggttaggcattgtcggaaccgtgtttgctaatgttttccgattggttgttggtgatagctttctagttgtcagcgcagggatgatcctgatggggatttggtttctcttcgcagatcgattgccgaaattggcacggcatgtgtgggttggtctggcaattatcttaatttgtgccttggtactgttaagcgcaggcaccatgaccacattgaatgtgcacagtcattatttgttggcgacctggcgcctacttcaaaatgatttcggcctaatgacgacggcctctagtgttggcgggggattgatcggggcgggtttgtatgcgttacttgcccctttactaagcagcatcggtgcaacgattcttgcatggctaggcatcgttgttggtacattagcttttctaggtgtgggtgcgaatcaggtttttaattggttgcagcggtgtgggcaagcttgtaaacatggcgtgatgcaggtacaagcagccgtggcggctatgaaaaaagaacgcgcgcaaaaagcggctgcccagcagaaaaaaaccgtttctgcgaagccacagacaactacgccggttaccgaaaacgaagcacccagtgaaacacctgatcaccaggatgatttcacgattaacgggccggcaccggttcacgaatcgacgcaaccggctcccttgccacgcacagaacctaagccacagtcagctacgactgcgccacaacctgagcctagtgaagcggcatctggacttgatgcagacgatccttccacgaattatcagttgcctgatcttgacatgctgacaacgattccgccagttgatcaaagtgctgaatacaaggcgatcaaaacaaatcgggttaaactaaaagaaacctttgaaagttttggggttcatgttgcggttaaaagtgccacacttggaccatcgattacccaatacgagattcagccagcggtcggcgttaaggtttcaaagattgtcaatctttcggacgatctggccttagctttggcagcaaaggatatccgaatcgaagcaccgattcctggtaaatcattgattgggattgaagtgccaaatcaacacattgcaacggtcggcttcaaacaagtcatggcagaaacgccgaagtcgcctgatcgcccattagtcttaccattgggccgcgatgtgaacggcaaagtcgtgacttttgatttgacaaaaatgccgcacttgctgattgccggcgccaccggttctggtaaatcagtcatgatcaacgtcattttaactagcattttaatgcgaacgaagccaagtgatgttcgcttaatgttgatagatcctaaacgggttgaattgtcggtatacaacggcgtgccgcatctattaacgccggttgtgacagaagctaaacgggcgccaagtgcgctgaacaagattttaacggctatggatgagcggtatcaacgttttgctgcggctggcgtgcggaatatgaccgaatttaatcaaaaggtggcggctgatccgacaagcggccaacaaaagatgccgtatattgtcgtgatcatagatgagttgagtgatttgatgatggtggcaggtaacgaaattgaaactgccatcgtccgcttggctcaaatggcacgagcagctggtattcacgtcatcattgcgacacaacggccgtctgtggatgtcatcactgggctaatgaaagcgaatattccctcgcggattgcttttgcaacgtctagtggcatcgattcacgaactattttagacagtaacggtgccgaaaaacttctgggtcgcggtgacatgctcttttcaccaattggggcatctaaaccgatgcgaattcaaggtgccttcataccatctgtggacgttgagcgagttgttaaggcaattactgaccaagtttcacctgcatatgtggagagcatgacgccaacggaaaatacggaggctgagaaacccggtgattcagaggatgagctatatgatgatgcgaaggcgtttgtcatttcacagcagagtgcctcgacgtcaatgctgcaaagacgcttccgaattggttacaatcgagcagcgcgcttgattgatgatcttgaagccaatcaaattgttgggccaagtgaaggcagcaaaccgcgcaaagtctttgtgacgccagaacaagtaacgaatggtacgccatcataaggagttttatgcgaaaagaaatgaaaccgggtgtttggttgattgtattgccgacaacgcaatttaaaaccacccgcatcaatgtgcaatttttagcgccgttgcaacgggcaacagtgactaaacgaacattattaacaagcctgttagaaacgaatagcgctgtctatccgacgcaagcagctttgtcagcacatctcgagtcgctctatggcgctaatttcagtattggcgtggcccgtgaaggcaagttgcatcgaattggcgtgacgatgagtaccgtggatgatcggtttaccgatacgcctttattgcctcaagcagcggccttcttacgcaccatcttgtttgaacccaacatgcaggcgggtagttttgacgaagccacttttgcgcgggaaaaggagaatttggatcattatttagccagtctagatgatgatcgccaaacccaagcggcgctgggagtgcagcaactatattttggagctgatcaggatcaggctattccgagttttgggacgcgggaagatcttgcatcgctgacggcgtccagtttggctgcttactatcaagaaatgatgcagcatgatcaggtcatcatcacggtgttaggggatgttgatcctaagcaagtggcagcattatttgctgattggccacttgatgctcggtcacaaaccgtaccagcagtggcgtttgatttaccgacgcatccagatgtgctgacccaaacaaccaaggtgaatgcgcaacaggccaagtttgacttggcttatcatgttgaaactgatttgatgggacccaaatatgcagcaacattggtggcagaggaattatttggcggctcgagcttgtcacttctattcaccaatgtccgcgagaaggctagtttggcttattatgcgagctccatgttcgatgcttttcgcggcttgatgctggttcaaaccggaattgaaggaaaagatcgtcagcaagttgctgatcttattcgtgatcagttggccgcagtggtcaatggcgatttttctgacgccctattgaaggccgtgaaggacggcattttggatcatcagcgtgccgcctatgacagcccacggtttttgacaaaccaggcgttgtatcagttgttagtaccagatgcgccacagaattttgatgagtttgctcagcggattaaggcggttgatcgccaagcggttcaacaggccgccgcagatatgaaattgcaggccacctatttcttgactggggaggatagcgaatgaagacacagtattttagtgatgtcgatgaaacggtgatcacgaccacgctatcgaacgggctgcgattgcaagttgtgcctcgcccggcgtatcacaaaagctatgcgatcatgacaaccgattatggttcgattgatacgcaatttgcaccagatggcaaacagatggtgacttatccggccggaattgcccactttcttgagcacaagctatttgaaaaggaagatcatgatgcctttgatctttttggtgaaactggggcatcagcaaatgcattcacgagtgcgaccaaaacgagttttttattctctacgacaacgcagctgacgaagaacttacagattttactggattttgtgcaaacgccatttttttctaaggcatcagttgctaaggagcaaggcattatcgggtcagaaattcaaatgtatcaggatgatccagggtggcgcggttatgccggtttgttagaaaacctttttccaaaccatccggcgcatgttgatgtggctggcacagtggcaagcattgcccaaatcacgccgggaatgttgtatacgattcatcgggttttctatcaaccaagcaacatgacgttgattgttgtgggaaatattgacgctgatgccattatggcttttgttgcggctaatcaagcagccaaacagtttccggcgccacaggcgattgtgcgtggcgttcacgcggatttgcagacggatgatatcgtgccatatcgccagttggagatgccaattagtcgcccaaagacactggtcggcatcaaagggcaggttgcgattcctacgacggctgagggctggcggtaccaattaaccattcggctcttgctagaagttctgtttggcgattcttcccagttatatcaagattggtatgaccgaggattgattgatgactcatttgattttgattttacgaaccagcgcagctttagttatggcttggtcggtggtgataccgatgatccgcatgcattaagtgatgcgatcaaacatgtgttgctaaacgcagcgacgcagccggatttgacccgcgaccgggttgctctaattaagcgggcgtcactgggtaaatactacgctggccttaacggactgaatggtgtggccaatcagctaagtgcgttgagttttggccaggcgagtttgtttgatttccccgagattttgagcagcatcacgctagcggatttacaagccatgattgatcaggtttttcaggcgaaagcattgaccgttttagatatgattccggaggcagattgatgcgagcagctttgattgttggtgcgtcgggtgacattggccaagcggtggctaaaaagttggcccacgatggctggtcattgtacctgcactattttgaacacgaacaagtggttaccagccaaattgcgacttttcaagcggcgtatccgaatcaggattttattccgttacagtatgatttaactgatgatcgtcatttggatgatttgacggcccagctttttagcttggacgcggtcatttttgcggcagggatgacgtattatcatttatttaaagatacaaccgtttctgaattaacaactttgatgcgcgtgcatctattgacgccgatggctcttttaacgaagatcgagcacaaattagcacagtccggtcatggccgcgttgtctttatcgggtctgtctatggtggcgcaggttcagcgatggaagtggcctatagtactgtcaaaggcgcgcaaagtgcctttgcaaaagcctatgctcaggaagtggccagtctgggcatcacggtcaatgtggtcgcgccaggtgcagtgacaacaaaaatgaacactaaaatgtttgatcaagcgaccttgaccaaggttcgagaggaaattcctgctgcacgatttgcgaccccacaagatattagttactatgtgactatgctagttgcaaaagatgctgcttatctaacaggacaaactttatatgttacaggtggctggcgaatctaggaaacaaaggatttcttaaggcttgcagttggtttttcatgatatactgaaaatggtcaataaaaaatagcgggtgaataaaacttatggatgaaattgggcaaaaattacgggacgcccggattcaaaaaggctatacgattgatgatcttcaacagatcaccaagattcaaaaacgctacctgatcgcgatcgaagaaggtaattttgatgcgctgccaggcgacttttatgtgcgtgcctttattaaacaatatgctgacactgtcggccttgatggggatgcgttgctgacgcaattccagcaggacatcccggaacctcaaccccaagagtatgcagcacaatcagttgaaaataagactcgggcaacccgcgccgaagaagcgagtccggttaaccgtttgcggcgttatttaccgcaaattgcgattgctgcagttgttgtcgtggcagtcattgtgatctatgtcatcatgttggtttaccaatcaggacccaagcaaacgatcccgacagattcagaaagtgttgcggtctcatcgaagcgtagtacatccaagacttcgaaatcgtcgacatcttcgaaaacaagcaagacatcatcggcttctagttcttcgaagactgcggagaagtcgtccaagaagagtactaaaaagagttcgaaattggacatttctgtagcggatgccaatggtgctactcaggcagttactttaaagaatctgccgaagacgggtaacaagttaacgcttggtgcaaccggcgccactgcttggatttcagtgattgtgaacggctcaacgacgtggcaaggttcattgacatcaggtaattcgcaagaagtgacattgccagacaacgtcacgacattccaagtgcggtcaggcaatgcaactgcgaccaccatcaagctcaatggtcagagtgttgatatctcaaagggaaccagcatcgtacggaccatcaccttcacggctgatgcaacagaaagcgagggttcgcaagaatgaatcttccgaataaattaacgctcatccgaatttttctgattcctgttttcacgatcctgctggcacttgattggccggctgggtatctgacacttgcaggaactaaggtcgccttgagctggtttatcgcgctgattatttttattgtggcctctttaaccgactttgctgacggtcaaattgcccgacgcaagcatttggtcactaatttcggtaaatttgccgatccactggctgacaaactgttggttatgactgccttcatctttctgacggccaatggtcagattccagcatggggaaccgcgattatcctgtggcgtgaattagccgtaaccggattacgcttattgctttcaaacgaaggtgaagtcttagcagcggcttggccgggaaaaatcaaaacaaacgcgcaaatgtttgccattattttcttgatgctaaacaacgcatggtttaacaatatcaatgtgccgtttgcactgatcctgttctatatcgccgttttcttcacgatttactcaggtgtcgaatacttctacaaaaaccgtggtgtgttcaaggactcattcggttcaagtcatcaataataagttattcaaatacccaggcaggtgcttgggtatttttgtagagcgcgagcaggcccgtttagaaaccggagcataagtggcctcaagcctaactggcagggctttggccagttaggcttgaggcccttatgtgcaggtttctgggcctgcgagcgcgtttgcgagcgcagcgtgaagtcgccactaacctaagctgggtgggagccccaccagcaaatacggagatccctatgtgcaagcttttggaccagcaggcccggttgcgagcaaagcatgaatcagccaacaaaaattgcacgctaatcttagtaaagatgtatctaagcaccatacagctatttagttgcaactttttttaaaaatgtcaggtcaagtaccttaaaaaacgaattctattgttaggtgggaaaagtatgcaagcagagattattgctgtcgggacagagatcctgatgggacagattactaacacaaatggtgcctatatggctaagcaactgacagcactgggtattgatagctaccatcaacaggtggtgggagacaacggtccgcgacttgaggaggccattaagttggcggaaagtcgcagtaatttagttattttgattggcgggttaggaccgacaccagatgatctgaccaagcaaacattggcagcgcacttgaaccgcaaattggttgaagatcctgccgctatggctaaattacaggcgcgcgccaagcaacagcagcggccaatgacgcctaataatcaattacaggccatgtatccggaaggcgccgatattttggtcaatcgggttggcttagcggttggtgcgtggatcgtcaatgggcagcacacctatgtcttattgccgggaccacccaaggaattcgttccgatggttgatcatgaactgctgccgcggctagcaaaatggagcggccacgcggaagttatggtcagccgggtcttacgtttctttggcattggcgaatcgcaactagtgacagatctggacgacttgattgccaaccaaaccgatccgaccattgcaacttatatcaaggatcatgaggtgacggtgcgcgtcactgccagtggcgctaacgaaaaagacgctgatgcaaagttagaaccaatggtcggtgccatcatggatcgtgatggtcaatatttttacggctacggtgacgacaatagtttggcaaaagagcttgtgaagacgcttgcggcaaatgatatgcaaattactgcagctgagagtttgactgccggcgcatttcaagcagcgttaggcgatgtgccgggggtatccacttattttaagggaggttttgtcacttactcacttgcaacaaaggccgcttttttggcaattgatgctcgcgaattagcggcacacggagttgtcagcgcatttacagccaaggcgatggctgaacatgctcggcgtaaggcagcggcggatataagtgtcagctttaccggcgttgccggtccagacacgctggaaggacagcctgctggtacggtttggatcggtttagcgcggcgcggccaactgcctgaagcacatgtttaccattttcctggcggtcgcaatgatgttcggcagcgtgctgtgatgactggtatgatgcttgcattaagggcgctgcaggcctaacagaatcattctttaacacgttaatacgtcaggtttacgcaagaggaggcggcaggatggcaggagacgaacgccagaaagcattggatgttgcactgaaaaagattgaaaaaaattttggtaaaggcgcgattatgcgaatgggtgctaaggcggacacgcgcgtttccgttgtctctagcggctcacttgccgttgatgatgcacttggtgttgggggctttccgcgcggacgaattgtcgaaatttatggaccggaaagttccggcaaaacaaccgtcgcgctgcatgctgttgctgaagtgcagaagcaaggcggtactgccgcctatattgatgccgagaatgcgatggatcccaagtacgcaactgctttgggcgtcaatattgacgaattattgctctcccagccagacacaggcgaacaagggctggagattgctgatgaactagtcgcgtctggtgccattgatattgtggtgattgattcagttgctgctttggtgccgcgggctgagattgagggcgatatgggggatgcccatgttggcttgcaagcccgattaatgtcacaggcgttacgtaagttatccggttccatcaataagacaaaaacgattgctttattcattaatcagattcgtgagaaagtcgggatcatttttgggagtccggaaacgacaccaggtggtcgtgccttgaagttttatgcgactgttcggttagagatccggcggtcggaacaaatcaagacaggcgcagatgtcgtcggcaatcgcactaaaatcaaagtggtcaagaataaggttgcaccgccttttcgaacagcaattgtggatatcatgtatggccaaggcatttcgcaaactggcgaacttgtcgacatggccgttgagagagatattgttgaaaaagcagggtcatggtacgcgtatcaaggtgaacgcatcggccaaggtcgcgaaaacgctaagacatatcttgataaccacgctgatcttcagcagacgattaaacaacaggttcgcgtggcttatggtatggcagccgcacctggtcgggagacggcttcggtcagtgaagatcaacccgaaatacctcaacaggctgaagtatgaatcatgagtcaacttgctgttgtcggatgtgatgagtccgatggcgcaagtttttttatctgagcggtcttaaagagatttgatatatgttttatttttctcagttcgtaaaaagcatcacccagacttaagactgctttaatgctggtttttaggcgccgctatgcgcctcccgcttcggttgacaccttgcaccctagcacgtaaactaatagaggtgtaataatttaaaaaagcatcaaagattttgatcaaagtttgattgaatcgcttagatgatgcggaggtgaaatgatgagttcagtaacactggtctcaataaccctcgcagcagtcatcgctttagcggtcggtttattgatcggatttgcacttcaaaagaagctccaccagaacaatttggatcgagcgacgcagacagcagaaggcattattgaggccgctaaaaaagaagcagcgactttaaaaaaagaaaaactgctggaagcaaaagacgagaatcatcgctatcgaacccaacttgaagatgaattgaaagatcggcggacagaagtccagaagtcggaacatcgactgaatcagcgagaggatactttggatcggcgggacgatacgctagatcgcaaggaacaaagtcttgctgaccgggaagcaaatttgaacaagcggcagcaacagctagatgaacgtgaacaagatatctcttcagaaatcagtaaacagcacacagaacttgaacggatcgccgagttgactcatgaacaggctcggcagcagattcttgaccagacacaatcagaactgacgcatgaacgcgccgtgatgatcaaagaaagcgaagatgaagctaaggaagccgcggataagaaagctaaagtactgatcgccgatgcgattcagcgcagcgcttctgacatcgttgccgaaacgacagtgaccgtggtgaacttgccaaatgacgacatgaaaggccgaatcatcggccgtgaaggtcgaaatattcggacacttgagactttgacaggtatcgatttgattattgatgataccccacaagccgttgttttgagcggctttgacccaattcgccgggaaatcgcgcgaattgctttggaaaaactcattcaagatggtcggatccatccagcacgaattgaggaaatggttgataaggcgcgcaaagaaatggacgaccggattcgtgaaattggtgaacaagccattttcgacgtcggtatccataatatgcatcccgatctgattaagattttgggccgattgcacttccgtacgagttacggtcagaacgttctggatcattcgattcaggtcgccaaactgactggtgtgatggctgctgaattaggagaagatgtcaccttagcgaaacgcgcggggttattacatgatataggcaaggcgcttgaccatgaagttgacggatctcacgttgaaatcggggttgagctggcaacgaagtataaggaaccaaagacggtcatcaacgccattgcatcgcatcatggtgacgttgaaccaaccagtgtcatttcggtactggttgccgcagcagatgcgatttcagctgcccgcccaggcgcgcggtcggaatcgcttgaaaactatcttcatcgtttggagaaactagaagcaatcgccaacagtcatgctggcgtggatcatagtttcgctattcaagcaggtcgagaagtccgggtcatcgtccaaccggaaaagctctctgatgatcagagcgtcatcttggcccgtgatattcgcaatgaaattgaaaaagaactggagtatccaggccatatcaaagtcaccgtgattcgggagacaaggactgtggaatacgccaagtaaaaaacacagtacccaccagcacaaagttggtgggtactgtattttttatgctgttttagttcggacgttattgttagacagttagatgtcctcttagagcttaggctttgttgataaagggacttcgcggtattgactggcgccaatggtaggcgaaaactgtccattcaagaaatcatttagggccgcgagcgtcgcctgcaaatgctcatcatctagatacagggtgatggtaacagcagtcccgtaatcagtgttcgcaattgacaaatgattggttgtcaaaaaatgctgaattggatcaaagtcggcgtaaggaatggtaaaagttacagctttttgtttgatgcgcgccacaatgccgatggtttcgatcgccgtgttggcattgcctgcatacgcccggatgagtccgccagcaccaagtttaatgccgccaaagtaacgagtcgtgacggctaccacatcacgtaagtcatgctgcaacaaagcctccagtgttggggcaccggcagttccagaaggctcgccattatcgcttgcgcgttgaatttgattggtatcgccaagaacataagcaaaaacattgtgggtagctttggtgttttcctttgatacttgcgcaatgacggccttggcatcatcttcgtccttgatgcgcgcaagatgggtgatgaaacgcgattttttaatggtatttgtgtagttgccggtttgttggatggtaagatattgctctgacatgcgtaatctccttatgaggtgatcatgatgaatcttgctggggcacaattgacagaaaatgaactgatgcgcttaaccgtttctaatatagcacaggccacatcactgccagcgttgattcaagaacacgggcgctggtgttgccaacgttgcggtgatcgaaagccagttcaattgcctgatgggcggttttattgttcagcttgcgtgagtataggccgcttaacaaatcgtgatttgctttaccgctttgaacagccgcaccggcctgttggcgacggcttattaacgtggcacgggacattgacgcctgcccagcaaaaagcgtcaacggctttacaaacgagtgttacagcaggggctgatcatttgatttgggcagtgacaggtgctggcaaaaccgagatgctttttccgaccatttcacagatggtacaacaaggcaagcgcgtggctattgtttcgccgagaattgatgttattcgggagcttgcgccgcgactgcgaactgcctttgcaaccacgcccatcgccgttcgatatggcggtcattttgatcaaactgacagtgatttgatgctggccaccgtgcatcaattattacgatttcatcgggcttttgatctgattgtcgttgatgaggtcgatgcgtttccgatggcgggaacacccatgctccatcgggctgttcaaggtgcccggcgtggaccggttgtttatttaacggcaacgccggatcggccattgaaggcggcgatgcgtaaagggttgatggtcagtcgattgtttcgtcgatttcacgggcaccctttgccagttccagcgattcggttggtgaattttaaaaaattaccgtcccagttgccacctgccatcgtgaagtgggtgcgtgatgtcgtggcgacagggcggtcatgtttgctgtttgttcctaagatcagctgggcgcctcaaattgctgcgcttgttcaacgtaacgggctaagggtagctggcgttgctagcacggaccgtctacgggcagagaaaataacggcttttcgtcagcggaaaattcaggttttagtcacgacgacaattttggaacgtggcgtaacggtgcccaggtgtgcggttggggtcgtggctgcagccgatcgggcattcacggcctcggcgctagtacagattgctggtcgagccgggcgggcagccgatagtgccgacgatccggttgtctttttcacggatcgctatacgttagcattgttagcggccaaacgtcagattgtcatgatgaatggacggtgatggtgatgcgttgttgcgggtgtgatcgccatgttgatcgtagtccgacattgaaggcgttgttagctggcagcaagttgatagcaccccgattgtgcagtagttgtttagcccgctttaagatgattactggagcgacttgtccaggctgcggccggtcgggtgatgcacgaatatgcgcggattgccgccaatgggagcagcaagggcggttgttacataatcgggctttatttgtttatgacgcagctatgaaacaatggatttaccagtacaagggtcttggcgattatcgcttacacgatgcgtttcaagatctcattgctgcacaattgcaaaatgctgggacactggtcgccattcctagcgaatccaaacattatgatgtgcggggatttgatccaattcagggactttttggcggtttgcagctacagccatggctacgtaaatcaccaacggccaaaccgcaggcgcagaaaaatcgtcgcgaacgattacaaacgccgcaaagctttaccgtacttgtgccagcagcaaagttgaatcaaaccaaacaaattacattggttgacgatttatataccacaggacggacattgtatcacgctcgcgatgcgcttgtggccgcgggatttcagggcacggtgaccgcatttactttaattcgctgaaatgtggcttttgttgtgtctggcgacaacattcgggtataatgaaattgaagattggaagggttttatcccaaccaatcgacgtgtaagtgtttattacacgtaggaaaggggagaagttttatgctcacatacaatgttcgtggcgaaaacatcgaagtcaccgaggccatcagaagttacgtggagaagcggattagcaaactgaacaagttcttcggaggttcggttactgcaacggcacacgtcaatttgaaggtttattccgataaaactgcaaaagttgaagtgaccatcccgttgtctttcttgaccctgcgtgctgaagaaaccagcccggatctttatgccagcatcgatctcgtgaccgacaagctggaacggcaggtacgcaagttcaagacaaagatcaatcgcaagtcacgtgaaaaaggctttggccaaatcgacattgatgcgactgcaccagctgaaccgaaaccagccgaagatgatgataatctgacggttgttcgaactaagcgagtgtcgttgaagccgatggattcgcaagaagccattctacagatggatatgttggggcacaacttctttatctttgaagatgctgacaccaatggcacaagcattgtttataagcggcgtgacgggcgttatggcttgatcgaaaccgacgaataagcagttcttaaaacaaaaaacaagatcgccgcaaaaggtgatcttgttttttgttgggaaagtttgccatatggacttattgctggtaagtttttattaaagtttaatgacaatatacaaattggggcctggtatatgaacttgcaggcagtgaagattgaggcgctatcgtgctggtattcagttgttattgtgaacggcatcggcgtgcgctcgtcgatgtggataatgcaggatctttgtaatgctcggttttcaatacccaatgaaaatgttaagatactatagatatactgtcagtttaacgaagtttcgacagagaggaatccattcatggccaatattcttagaaaatgggtcgaaagcgataagcgagaaatcgcgcgcctaggcaaaattgctgataaggttcagcaatatgaagatgagtatgcagcattatctgatgaacaattaaaagcaaacacaccaaaattaaaagatcgtctcgcagctggtgctacccttgatgacattctgccagaagcctttgcgactgcgcgggaaggtgccaagcgtgttttaggtctattcccgttccgagtccaaattattggcgggattgtgttgcatgaaggcaacattgcggagatgaagaccggcgaagggaaaactttaaccgcaaccatgcctgtttatttgaacgcactcactggtaaaggtgttcatgttgtcacggtcaatgagtacctgtcaacccgtgatgccacggaaatgggcgagctatacaactggcttggcttgagcgtagggttaaacctcaactccaagaacagtgatgaaaaacgagaagcttataattgcgacattacctattccacgaacagtgaactcgggtttgactatctgcgtgacaacatggttgtttacaaagagcagatggttcagcggccactgaattttgcaatcgtcgatgaagttgactctattttgattgatgaggcgcgaaccccattgatcatttctggcggcgcagaaaaaacaaccggtctctacattcgtgccgatcggtttgtcaagacgctaaaagcggagaccgattacaagatcgactggccaacgaagacaatctcgttaactgaaagcggcatccggaaggctgaaaagaatttcggactggataatctgtatgacaccgaaaatacggccttaacgcatcatattgatcaggccttgcgggctaattacatcatgctcaaggatatcgattacatggtttccgatggtgaagtcctcattgttgatcagtttactggccgagcaatggaaggtcgccgatattctgacggcttgcatcaggcgattgaagccaaagaaggcgtccaaattcaggacgaaaataagacgatggctaacatcacttatcaaaacttcttccggatgtacaccaagttggccgggatgactgggaccgcaaagaccgagcaagaagaattccgagaaatttataacatggaagtcatctctgttccgaccaacaagccagttatccgggttgactcccctgacgtgctgtacccgacgttagatgctaagttcaacgcggttgttaaagacatcaaagcgcgtcatgaaaaaggccagccgatgctgattgggacggttgcgattgaatcgagtgaacggcttagtaagcaacttgatgaagccaagattccacataccgttttgaacgcgaagaatcactttaaagaagcagaaatcattatgaatgctggccaacgcggcgctgtgacgattgcgacgaacatggctgggcgtggtacggatatcaaacttggacctggtgtcaccgaacttggcggtttggcagttatcgggacggaacgccatgaaagtcgtcgaattgataatcagttgcgaggccgttcagggcgtcaaggcgatccaggttctacacagttttacctgagccttgaagatgatctgatgaaacgctttggttctgatcgaattaaagctatgttggatcgctttaaggtggcggatgatgatcaggtgattcaaagtcggatgatttcacggcaggtggagtcagcccagaaacgggtcgaagggaataactacgacacgcggaagaatacgctgcaatatgatgatgtgatgcgtgaacaacgcgaggtcatttacaagcagcggcagcaagtcatcaatgaacaggaaacattgaagcctgtcttgatggctatgatcaatcgaacgattacacggattgttcagactcatacacaaggagatcagaaggactggaaccttgatgccttgtacgcttgggtcactgccaacatgattgatcctgagaaattcaaacgcagccagttagatggcaagtcgcaagacgagttgatcgggttactggccgagatggcggagaccaacttccagcaaaagaataagcagctaggcgatgacgcgcagatgcttgaattcgaaaaagttgttattttgcgcgtggttgattctgcttggaccgatcatattgatgcgatggatcagttgcggcagtcgatcggattgcgcggttatggtcaaatgaatccgctagtcgaatatcaagaagaaggctaccggatgtttgaagaaatgattgcatcaattgatgatgatgtgactcggctgttcatgaaagctgaaatccgacaaaatattcgccgttaataacggcttagcgccccagcaccgcggctacagcttgcgatactggggtgttttgaagcagtcgccgacgcacttagtcacgctacaataacgcaactatgtttaaaaaaagggagattacacgatggaactgagtgttatgcgcaacaccttggccgctatgcggaccaaaattaatcaatttagggggtcactttgacctcgatgcgctgaacgaacgcattactgaaaatgaaggcagaatggctgaacccggcttttgggatgactcggaggctgctcaaaaggttattgacaacaacaatgcgctcaaagaaaagcacgatcgattttatgcactagaaaatgagttggaagatcttgaggctggttttgagttattacaagacgagcctgataaggacttgcagcaagaagaagaagcaaagatcaaagatttacaggaaaagctggacaagtatgagatgcagcttttgctgaacggtccatacgatcacaacaatgccattttggaaattcaccctggtgcaggcggcacggaatctcaggattggggatcaatgctgatgcgaatgtatcagcgttgggccgatcagaacggattcaaagtagaagtggcggattatcagcctggggatgaagctggcatcaagagcgtaacgctgctgatcaatggcgagaatgcttatggcttgctgaaaagtgaaaaaggcgtccatcgacttgtgcggatttcgccatttgattccgctggacggcgacacactagctttgcctcggtggacgtgatgccggaactcgacaactcaatcgaagttgatctgcggccggaagacatcaaaatggaggttttccgctcaagcggcgctggcggtcagcatatcaacaaaacctccagtgcggttcgcttgattcatctaccaaccggaatcgtcacctcaagtcaggcgcaacggtcacagtttcagaacaaagcgactgcgatggcgatgttaaaggctaaattgtatcagcgcgaagaagaagctaagcgtgctaaggccaaggccattcaaggcgaacaaaaagatgtcgcatttggttcacaaattcgctcttacgtctttcacccatacacgatggtgaaagatcatcggacgaattatgaaaccggaaatggcaatgcggttatggacggggatttgaatccattcatcaatgcgtatcttcaatgggaacttgcgcaaaagaatcctgattaaactgtaatctgcctgaaaccttgctgacttaatcgcctgttatactgatgctagcttagaaaaaggagcaatttgcatgattcaaatggagaacgtgacgaagcagtatgctaacggcgtgactgccattaaaaatctcaatcttgagattcatgatggcgagttcgtctatgtgatcggtcccagcggtgccgggaaatcgactttcgtcaaaatgctttaccatgaactaatgccaaccagcggtacgattaaaattgatgattttgattttgcaacaatgaaaccgagccgggtaccatttttgcgacgtcatattggtatcgtctttcaagattttaaacttttaccgcggttaacagtgtacgaaaacattgcttacgcgatgcaagtgatcgaagcacctgacgaaaaaatcaaggaccgagtcctcgaagtactggggctggtaggtctcgaacaaaaactgcgccgttttcctgatgaattatccggtggggaacaacaacgtgtgtcagttgctcgtgccatcgtcaacaagcctaaggtattgatcgccgacgaaccgacaggcaatttggatccacaaacatcagatgaaattgttgatattcttgagcggatcaatgccagtgggacaactgttattatggcgacgcataacaaggacatcgtaaatgagcgtcagcatcgcttacttgaaattgctggcggccgtttggttcgtgacgaagaaggaggcacttacggtaatgaagactaagatctttttccggcatgtaaaggattcgctgcgcagtctgaagcgaaatggctggatgtcagttgccgctgtcagtgccgttacagttaccttactattggtcggtattttcatggcacttattttcaacttgcatcatgtatcagagcaagttgaaaatgacgttcaagtgcgtgtttacatcgagaagaaaactacgacgaaacaacgtgatgcattaaaaactcagctagaaaagcttgataatgtcaagaaagtgacttaccggtcacgtcagcaggaattgaacaccattgtcggcgggtatggttcgcaatggaaaatgttctctggcgatcagaacccattgagtgatgtcttcatggttaagacaagcaaccctaaggcgacgatcaaggtctccaaacaagctcaaaaactaaaccatgtggtggacgcaagttatggcggccggactgcgaaaaaactgttcaactcagttgattcagcacaaaagtggggacttggttttactgtccttctgctgttcgtggcggttttcctgataagtaataccattcggattacgattctgtcgcgttctgacgaaatcagaattatgcgcctagttggggcaacaaattcatacattcgttggccatttattcttgaaggcgcttggactggattgttcggggctgtgctgccaattgtgattgttgacatcggttatgccgttgtttaccgcagcttcagcttatcaagcggctctaacggttattcgctatatggcacgatgccatttctgctttggcttgatttgatgctggcgggcattggtatcatcatcggtgcattaggcgcagtcatttcaatgcggcgtttcctcaaaatttaatcgtgcaatttgtgaactcatcctcgctaatgacggggatgagttttttgctatcatactcggctatgcgggcctactcacattttgatttttatgacgttgtgggagcctccggcgatttctgctatactggtcacagtgaatattggagggttaccgatggcagttgtagttgccttacttatcaatccggttggtttggtgttttggctagcgctaggtttaacgatttggtttgctgtcaatcgcactgatcgcgagcgccgccggtatctgcgcgcaattcatcccaaacatccagaaattggtcggttcttctggatcggacttgtcgtaggtgcgctagtctcgctggtgatggttattggacgactgcagatcagtttagctgctttgcttgcattaagcggcttgacgttagtagcattgctattttctaaatggcgatttagcccttggtggctaggtcttgccagtctggcggcagttggtcagtctggtttgctagctgaacagcatgcagctaatttagctattttggtcggcctattatggctaacacaagctggacttgcgcgattcaaccgcggcgatgagatcgagtcgccggtgattcaacaagaccgccgccagcggcaaagtgcggcgtttgagttgcggcaactgttctgggtgccgttaatcttacctgttgctgttgaaaacgtcagcaacctcccactgctggcggttacagtgcagtctttgacttttgtgggcttgccgttgcttttaggtgcgaccttcatgactccgcgagatcgcgctcagacggcttggcggcgaagttggccgtggtatggcggcgcaggtggcgtgcttatcgtttatggcattgttgcccgcaccatgaccttgcctttgctgggtagtcttgtctttccagctgtggtgagtttagtattggttggcggcttcatttggcagggacggcaggtgcatctgacggtgactttagccgatcaaggtgtggtgttgattggtgtcgtgccgcatacaccggctgcagagatgggcttacaacccggtgatcgcgtattggcctgcaatcaccattccgtgaacaattctcgtgagctttacgatgccattcaaaaagaaccaacctattgccgcttgcggcttcgacaggcagatggtgagctgcgattagctgagacggccatttttgccggtgccccacacgaacttggtatgattttatttccggaggagacagcatgaagaagatcttgattgttgatgacgaacctgcgattttgacgttgctgcaatataatttggaagctgaacactatcaggtcgaaacagcgacagatggtcaggaggctttggataaagtgcgcaacgagccatttgactttatcatcctcgatttaatgctgccgagtctgagcggcttggatgttacccgcaaaattcgtgaagataaaattcagacgccgattatgatcttgactgccaaagacaatgaaaccgataaaattgttggcctagaactcggagcagatgactatgtgactaagccgttttcgccgcgggagatcattgctcggatcaaggcgattgaacgacggagtcagagtcagccgcaaaccagtcaaaaaccgggcaacagtgatcagatcacagttggccagatcgcgattgatccagaaaattataaggccagcaagggtggcaaacggctgcagttgacgccaaaagaatttgagctactggtttactttgctcaacgtgttggcaagaccttgtctcgagatgctttattgaacggggtttggggattcgactatcccgcagagacgcgaatggtggatattcaggtcagccatttacgcgataaaattgaaacggatccgaaacatccggactatttaaagacagttcgcggtttcggataccaaatggaggcaccccatgaataaacgaatcattcggcgtgcactcatcattagtctgctatcattggcaggcttttttgtgctcgtgacaacggtgaatcaacaaattgtccatcaacaagcgcgtgatcttcggcgggtcggccggacgtatgcggcctcgagtcatgatggggtcaatcggcaagcattggcagagtcagaggcagccttcatcacggtcattcccaataatccgcggaccacgcgtcaaaaagtgatggctgatgccttgcgtggtaatcgggatgcagcgtttgtaacaaccgtcaacgtgaatggtcgaacagagcaagcgtatttattccaaaataaagggcagtgggtggcagtcagccgctttaagtcaagtgtctggacaactgcaccagagcaattctggctcctaacgcttgcctttgcggcattgctcgctgccattctcatttggctttttcgatctgaacatcgttatcaagaagcgattgaagtcatgagccataatctagatcgcatccgtcgaaagaaagacccagatccggtgattttaccgcccgattcaccttttgtaccagttgctcgccgcatcaatgcattggccgctgaacaagcccatctccgtgaaaaagtggcggtgcgtcaatcaagttttgatcggttgattgataacttgccattgggagtcatgctgattgacaccgataaagatgtcatcttgcataatcacgccatgtcgcagctgctaggtcatcaaatcccgcagccccgacacagctaccttgatgatgttaaaacttatgccttggcgcgcatgatcgaacacacttttcgccatgaaaaaacgcatcatcaggaactgacaattttgaccacgcaaaaatccgttgatgcttcggttattcctttgaatcaaggcatcagtcggttgcaggtgctggtgattctatatgatgtcacttacttgcgacaggttgaaaaaatgcaactggactttgtcgggaatgtcagccatgaattgaagaccccagtcacagctatttctggatttgcagagactttgcttggcggtgcgaagaatgatccggcgaccttggacaggttcttagggattatttatgacgagagcaagcgattaacacaattaattaatgacattttgaccttgagtcgaccggattccaaccaaaatgtggctgcatcggttgctttgaaaaaattggtcgatgatgcattgcataatttggccaaagtgattcaagacaagcaaattcgcgttgaagtggcaattaccccggatctattggtcgtgactgacgagcgcaaattgacccaaatcgtgcgcaacttattgaacaacgcagtcttctacaatcgcttggctggtcatgtcacgatcagcgctcaggttgtcgatcatcagctgtcactggcagttgccgacactgggatcgggatttctgagacggaacaggcccggatcttcgaacgcttttaccgagtagataaggctcgcagtcgtcacaatggcggtaccggtctcggtttagcgattgtggccgaactggttaagagtatggatggtcatgttgcggttcacagccaagtaggggttgggtcaacgtttacggtcactttgcctgtgggtgagggcccgcacagaggatgaaaaaccgcagccatcatgcctttacacaatctttacattcaatgacatgaacatttacatgtaactgataaaataattggagcttgaaatggaggatttcgtgtgaaaaaaattgtgaccctgttgagcctgctgtttttgccactgttaatcagtgcttgcaacagcagcagtcaacagtcgggagaatcgatcaccgcagttggatcaagtgccttacagcccttggttgaagcggcgggtgaacaatatcagacggaacatttgggggtctttatcaacgtccaaggcggcgggagtggcacaggtttaagccagatccaacaaggtgctgtggacattggtaattcggatctttttgctgaagaaaaagctggtatcaaggccaaagcgttggttgatcataaggtagcagttgtcgggatcgccccgattgtgaatccgaaggttggcgttaaaaatgtctcgatggcacagctgcaaaaaatctttcttggcgaaattaccaactggcagcagttgggcggcaaaaatgtgccgattgttctagtcaatcgagcgcagggctcaggcacacgcgcgacttttgaaaaatgggtgatgcaaggcaaacagccaatggccgctcaggagcaggattctaccgggatggttcgacaaattgtcggcagtacgcctggtgccatttcttatgtggcgttttcgtacattgataaaacagttcaggggctctcagttgatggcgtcgcacccacggatgcaaatgtcacgaccaatcaatggcgcatttggtcgtacgaacatatgtatacgaaagggcagccaaaaggactcactaagaaatttttggcttatgtgatgtcaccagctattcagaagaagcttgttttgaaaatgggttacgtcccgatgacacaaatgaaagtggttcgggacgcgaatggcaaagtgagcaagcagtaacctgtgatgttatcaagacacggtcagatccgttggctgtgtcaggtgtcggacagaagcgtgatctaatccggatagaaaccgatgttgtggtcttcgccgggaaggttttagttagaaagcgcgtttaggaggtcaagatggatccaattcgggaagcaatgctcaaaaaatcgcgttcagctaagttagagcagcgtggtaaactgatcagtttgctttgtatcagtttaattgtgattgtggtggtggcaattttcttctttgtggcatcgaaaggactagctaccttctttcaaaacaagattaatctttggtcgtttctaagcaaaagtgtttggaatccgtcaatcaaagatgcgcacggcaatcccgaagttggcgccttgccaatgatcgtcggttcgtttggtgtgacattcctgtcagcaattattgcgacgccgtttgcggttggcgcaggcatttttatgactgagctttcccgtaaatggggacagaagattttgcaaccggtgattgaattactggttgggattccatcagttgtttatgggttcatcggcctctccgtcatcgtgccttttattcgccacatttttggtggtactgggttcgggattttagctggtacttttgttttgttcgtcatgattttacccactgtgacatccatgaccgtggacgcgttaaaagctgttccacgacattatcgtgaagcgtcattagcattaggtgcaacacgctggcaaaccacgtatcgcgtggttctacgtgctgcgattccgggaattctgactgggattgtgtttgggatggcacgtgcctttggtgaagcactggcggttcagatggtgattgggaacgcagcgcttttaccgaaaaatttggtttctccagcttcgacactgacctctgtcttgacgagcggtattggcaacacagttatggggtcgctagataacaatgctttgtggtctctggcattgttgctgctcctcatgtcgctagcctttaatctgctgattcgctggatcgggaagaaaggggagttgaacaaatgaatccaaaagttgctgataaaatcgcaacgacggttttgtatatcgtctcaggtatcatcattatcatcttggcgagccttcttggatacattctatttcaaggcctacctcacatctcctggcattttctgacaagtccggctcaaagctttgaggctggcggcgggatcggtatccagttgtttaactccttttatctcctgctgctcgcaatgttgatttccacgccaatttcattgggtgcagggatttacttgagcgaatatgctaagaaaaactggctgaccgatgtcattcggacgtccatcgaaatcttaagctcgctaccttccgtggtggttggtttattcggcttcttgattttcgtgttgcagttcaagtttggcttttcaattttgtccggtgcgttggcgctgacggttttcaacctgccgttgttaacgcgtaacgtggaagactcgttgcgtggagttgagtatgagcagcgcgaagccggtctggcgcttggcttgtcacgttgggaaactgtcctgcacgttgtcattcctgaagcattgccaggtatcattactgggatgattctcggcgcagggcgtgtcttcggtgaagctgcggccctgatttataccgctggacaaagtgcgccagcgttggattttaccgactggaatcctgctaacatcgcaagtccgcttaatcctttccgtccggcggaaacattagccgtgcatatttggaagatcaactcggaaggcattcagccagatgccgttgccgtctcggccggtgcaagtgcggtcttggttctggccgttctgctgtttaatctcggtgcgcgctactttggcaatcgcctgttcaaaaaaatgaccgcatcctaatgtgaatacgcacatgccattgcagtggagttggtgatggtggtcataaagttggcgacaaaacgcttggaggctcacgatgcaagaacttgaaaaatattcattagatgacacttatattcgtccattcgatcgcgacaagcaggaaattgcgatcgaaacagagaatctacgcgttttttatggtgagaatgaagccattcataatgtctctttaccgtttgagcggtataagattacggcattaatcggcgccagcggttcagggaagtcgacttacttgcgctcgttgaatcgcatgaatgataatattgaaggtgcacgtgtcaccggcaagatcatgtatcgcaaccttgatatcaatagtgacgcggtggatgtctacgaaatgcgtaagcatattggtatggtctttcagcggcctaatccatttgccaaatctatttacgacaacattgcctttgccttacgtcgatttggattaaaagacaagcaaaaactcgacgagatagttgaaaccagtttgaagcaggcggcgctttgggaccaagtcaaagatgacttgaatcaaagtggcatgtcactttcaggggggcaggcgcagcgtttgtgtattgcccgcgcgattgcgatgaagcctgatattttgctgttagatgaaccagccagtgcgctggatccgatctcaacttcggcggttgaggataccttgatgtcattgaaggataagtatacgattatcatcgtcacacacaacatgcagcaggccgcccgaatcagtgattacacggcgttcttctacagcggaacggcgatcgaatatgacgaaacccgcaaaatctttacccggcctaagatcaaagcgacgaacgactatgtctccggacatttcggctaggaggaacacatggctgaagcaaaaaaaatcattaccagttcaaatgttcatcttttttatggcaaatttgaggctttaaaaggcatcgacctagacttcaatcagaatgaaattacggcgttaattgggccatctggctgtggtaagtcaacgtatttgcgaaccctgaatcggatgaatgatctcattccgggtgtcaccatcactggcaatgtcagtttgcggggcaataacatttattcgcccaatgaagatgtcgttcaattgcgaaaacaagtcggcatggtttttcaacaacctaatccatttcctttttcgatttatgaaaatgtcatctatggtttgcggctggcaggcgttaaggataaagccgttttagatgaagccgttgaaaccagtttgaagcaggcagcaatttgggacgaggttaaggatcacttgcatgaaagtgccttatcattgtcaggtggccagcagcagcgggtctgcatcgctcgggtgttggccgttaaaccggatgtgattttgttagacgaaccaacaagcgcgcttgatccgatttcgagcacgcagatcgaaaatatgctgctggaattgcgtgatcagtatacgattattctggtaactcacagtatgcaccaggcctcgcggatttcagataaaacggctttcttcttgacgggtaatctgattgaatttgctgacacaaaacaaatgtttttaaatccaaaggaaaaggaaaccgaagattacattactggacgcttcggataggaggggtagtatgcgacgactttttgttgatgaattgaacgatcttcatgtgcgcttttcggaaatggggatgatggtcaacgaggccatctataagtccgtgaaagcattcatcaatcacgacaaggccctggcccgcgaagtgattcatgaagataagcatatcaatgaacgtgaagtagatttggaaaaacgcagcttcgaattgattgcactgcagcagccggttacgactgatttgcgggtgattgtgacggtcatgaaagccagctctgatttggaacggatgggtgatcatgcggtatcaattgctaaatctaccattcgggtcaagggtgagacccgggttcctcaaatcgaggaagatatcgctggcatggctgaagcggttaaagagatggtagaacaggttctggatgcgtatgtgaaggaagattctgctcgcgcccgcaagattgcgcttgaagaccatgggatcaatgacttttcatcacgaatctacaaggaatgtattcggcagatgcaggataatccagaaacggtgatcggatccatggattacatgctggtttcttcctatcttgaacgaattggcgattatgtcactaatatctgtgaatggattgtttatctcaaaacagggaagattaccgaattgaactcaaatgctattgaggataagttctgagaaaatgacgctcttgctggcttgcaagggtgactgaaaaagattgacattgattgttattttgaaagagggatgatttttacttttgtgaaaatcatccctcttttgatctctcatggatgacttactaatatctaaagatcccggtgccaaggcggagcaatcataggctagatggggttcagccgtgcaaacatcatcagctcagcgttgccagccccatctggctggcgactgtggatagattttttttgatgaacgcgctgatgatgtgtctcatgtcaataaccagatgagtagatgcattactttcaagcgtccgtcttccgacccgttcaaaaatcaacctttggacctatgcgccccggcgcgaatccgtgcatactaatcatgtaatcaaatcctggagggataacccatgaatgaacgcgaaagaattttagacctagttaaaaaaggcgttatttcaagcgaagaggcgctggtacttttggaaaacctggcgaaacgtcaaggttcccagcaggccgctagcccggccgataacacagctcccgaagaaacttcggaaacgccgaatacggatgatgagcatgcaaccagtgacacggatcgcaatgaagcgctgacagaactcaacactgagattgctgaagcagcaggtgccttagatgctgctaccgcacaggttacaactattggtaaacaaatcgatgcgaacaacgaacagatcatcgtgctggacacgatggaagatctcgaagccctttccccggaaaaataccaaaagcgcggggatttgaaacaggagaatcagaaattgactgatcagttggccgaactaaaaggccaaattgagtctctgaaagcgaaccttgccggcttacgtcaccaaaagcatgatttagagcgtaagaagcttggcgacaagattttaaatgacgattggcaaaaagatgctcgcgatgctttttctgagtttggcaaaaacttaggtgatgcaaccacgcaactgggtgggttcgtgaaggatactgtcaacaatgttttggataacgttgactggaagaatgtcaccattacagtacccggtttagcaactgaaaaatttgaccatgttttcgattttccagatagtcaggcaacgattcttgatgtgaaagttgctaatggtgacgtgaagttcaagacttgggatcagccaggcattcaagttgctgctgcgatcaagttgtacggcaaaatggatgccgcatcgccgctggatgcgttcaaagaccggagccgcattgatgtcacggacgatcattttagcttccaagtaccaaacaagcgggttcaagctgatttggtcatctcattgccaaagcgcagttatgatcatgttgctgtccggttattaaatggcagtgcagacttaactggcattaccggtaaagatttctatgttaagagtacaaatggtcagatgaacttcactcatgttgatggtgttatgatcgagagtgaaggtgtcaacggctcaatcaaggttcaaggtggtcatacccatgacttgttgctcacaacagtgaatggcgatgtcagtgttgatgccgatccggcaacggccgccttaaagacagttaacgggactgtgcgagctacctatcacacggacttcacgacgcttgaaggcacttcgatgaacggcaatgttaaagtcgccgtgccgtcctccattgcgcttaacggcgaggttcggacgcattttggcagcatcaagagccgcttgagtgaggttgccgaaccagctaaggggattaagcgtctggaactgacgcgtcccgggactggcagtagtgaaatgaaactcaatacaaccagtggtaacattcaattaaaagattcaaatgactgaggggattgcttatgccttttctattaattccattaatgttctttatcattggcttgatcatcgtggcggtttttgccatcgggatattcctgctgaaacttctcattgtaccggccttactcatcatcttagctgtgtggctcttctcgcggcatgatcggtctgaccgttatgatcgtcggcgtccgcgtcacccctatcgtgatcgcgactcatctcggccccgaaaaaatgcaacgcatgtgaccgagtcgcatgacgatgactggagcgatttctaatgaacttcgtcaaacgcaccatcataacgacggcagttttcctgatttacgcgcaactgtttccggctcagctttatgtggcaggatttggcgttgcggtagtcggtgcattggtgctcggcgtcttgaatggtctgttgcgaccaattctagtgattctgtcgataccaatcacgattctgacactaggtttgttcctgatcgtgctgaatggtttgatgctaagcatgatgacttggttcgtaccaggcattgtgttcagcggtttcggcgctacgatgttgctggcggtcatcatttccgtgttgaacatgatgtttgtcggcaaaaattaaagtgacgattgaaaatggcttgcgatctgcaggccatttttgcgtgagttgaatgaactaaaggcttatcgttaccttccaacgaagcgcacaatgtgaatgaccttttgcgaatgtttcaacctgctgaccataaggggaatcgacttatggtaaaatagagcaaatatggcgaaagaaaggtggacttcatggcagacagcgtgacagtgcggcagttggttaaggcaaccaagctcgaggtatacagcggcgaggagtatcttgatcagcggcaagtcgttttgagtgatatttcgcgtcccggcttggaactgactggctattttaattactatccacatgaacggattcaattgttcggtcgaacggaaatttcatttgcgcgaaacatgtcatccgaagaacgtttattgattttaaagcgcatggcaactgaagataccccagcatttttggtatcgagggggttggaggcgccggcagaaatgatcaccgcagcgacagcggctcatattcctgttttgggatcgcgtttgccgacgacgcgtttgtcgagtctgattaccgagtatttggatagtcagctggcggagaggcgcagtatgcatggggtgctagtcgatatttatgggctcggcgtgctgattaccggcgattctggtgtcggcaaatccgaaacagcgttggaattggttcagcgtgggcatcgcttgattgccgatgatcgggttgatgtttatcaacaggatgaacaaaccattgtcggggctgcaccgccgattctttcgcatctgctggaaattcgtggcttgggcattatcgatgtcatgaatcttttcggtgctggcgctgttcgtgaagatactactatttcattaatcgtccatctcgagaattggacaccagacaaaacctttgatcggcttggttctggggaacagacacaattaatttttgacgtgccagtgccaaaaatcacagtgccagttaaggtcgggcgtaacttggccatcatcattgaagtcgcggccatgaacttccgcgccaagtcaatgggctatgacgccaccaagacatttgaaaaaaatcttaatcatctgatcgagcataatgaagaaaccgaccagaacagttcgggggacaaataacttgttattagcacttaatccgatcgcttttcaattaggcggtctggaagttcattggtacggtatcattattgccagtgccgttctaattgcggtttatctagcgatgcgcgaagcacccaaacgcgggattaaggaagaccacattttgaatcttatcttgtgggcgttgccgtttgccttgatcggcgcacggctttactatgtggcgtttgaatggccttactatgccgctcatcccggcgaaatcattgctatttggcatggcgggattgcgatttacggtgcattaatagccagtgtcatcgtttttgccatttattgtcgggtccaatggttgccagtttggcttgtcctcgatattgctgcaccaactgtgatgttggcgcaggcaattggtcgctggggcaacttcatgaatcaagaagcccatggtgctgtgaccacgttagcctatttacgcggcttgcatttgccagaatttatcattcagcagatgaacatcggtggggcatatcgtcaaccgacttttctgtatgaaagcatgtggaatctagtcggctttgctttgctcatgacggtgcgtcaccatgagcactggtttaagcaaggcgaagtggtgttgagttatgtgatgtggtacagctttggccgtttctttgttgaaggtatgcggaccgactcattgtatgtcatgcccggactgcgtgtttcacaattgttgtcgatcatcttatttgttgcagcggctggcttagtttggtatcggcggcggcaaggaaatgtggcatggtacttagacggcaatccgcttaaagcggtggaataggagtgattttgtgtcaacgaaaatagcagtgttaggtgctggttcttggggcaccgtgctagccaatttattaactgaaaatggtcatgaagttgatttgtggagtcacaatccggatcaggtagccttgatgaagcggacccatcaaaatgaacactatctcggtgctgagtttacattacagccggctttgcatgtgactgctgaccttggccaagccttggatcaagcggcggtcattttgtttgttgttccaaccaatgcgattcgcagcgtggccgagcaagttaaaccaattctgcaagctcataaagggcgtggtgaacaaccgattattgttcatgctgctaaaggacttgaacgtggcagtgagttgcgcatctcgcaagtgctcgcagaagtcttgccgaaggaattaattcaaggtattgttgtgatttccggcccgagtcacgccgaagatgtcgccacccacgatattacaacgttaaccgccgcttccgatgatttgaagttggcagaaaaagtgcagaagctgttcatgaatgattattttcggttgtatactaacacagacgtcattggcgttgaaattggtgccgctctgaaaaacgtgattgccattggcgctggtgccttgcacggtctcggctatggcgacaataccaaagcggccttgatgactcgcggtttagctgaaatcagtcgggtcggcgtgaagctaggtgccgaaccgttgactttcatcggcttatccggtgtcggtgatctgattgtgacctgtacctcggtccacagtcgtaactggcgagccggcaacgcacttggacaaggtgaaaagttgccggatgtgttgaaaaatatggggatggtggttgaaggtgtctcaacgaccaaagttgcccatcaaatggcccgtgaacttgacgttgacatgccaatcacagacgcgatttatcaagtgctctacgaaaacgcgccgattcgtactgtcattactgacttgatgaagcgttctggtaagccggaattcgattttgacaatgcgagtttacaaaaaccataaaaccatgtatattaaacagtatagcttactaattgtaagcaatatggcaaaaggagagactgcccatggcaaaaaaatatgatgtaatcgtgatcggtgccggcccaggtggtatgacggctgcactttatgcatcgcgtgccaatttatctgtgctgatgctggatcgcggcgtctatggcgggcagatgaacaataccgctgaagttgaaaactatccgggtttcaagtcaatcctcgggccagatcttggtcagaaaatgtatgatggtgccacccaatttggtgctgagtatgcctatggcaatgtcgttagcgttcaaaaccgcggtgccgtcaagctagtgaaaactgacgaggatgagtacgaggctaaagcgattgtcattgcgacaggcgcagagcataagaagttgggcgtaccgggcgaagaagcctacagcggccgtggcgtttcatactgtgctgtctgcgatggcgccttctttaaagatcgcgagttggccgttattggcggtggcgattccgcgattgaagaaggcctttacctgacacaaatggccaagaaggtcacagttattcatcgccgtgatcaattgcgtgctcagcagattatccagaagcgagcatttgccaatgataagatgcatttcgtctggaatgctcaggttcaggaaatccaaggtgacgatatgaaagtcaccggcgtgaagtaccgtgataaggaaactggcgaggaacatgttttgccagttgctggggttttcatttatgttggcattatgccgatgactgaagccttccaagatttaggtgttctggatgagcatggttggattccaaccgacgagcatatgcggacaaaggttccaggcgttttcgcgatcggcgatgttcgcgccaaggacctgcggcagattaccacagctgttggtgaaggtggcacagctggacaaggcgtcttcaactatattcagagtttgaatgatacgaatattgagattaaagcttgatttgaaaacaggttgagatattactcatacccaacaagtaaaggccgacgatttccctctaccctggaaaattgttggcttttttcgtggataattttttgttggatttaaagatactagtgccaaggcgtagcaatcgtaggccagatggggctcagccgtctccgctctagctccgcgtcgccagccccgtctggccggagattgcggagtttggcacggcaagaaagtattagcctagcaccgtcctacgattattcggaatttaatgattcacaagtccgacgaggaaattatggctcggcctcttttttgtggatgcgagcagaaacgcgtagaaacaagcagtcttggaaacttgttttagctagcacgcatcatcggtaataaaagaattttcttatttgagcgcgttttcaacccagcactcgtccacttatagtatgattgggacgggaagggtattgcccgaaattattaattatagacagatgggagctgatcacgtgagttatcgtgatacgtatcaacaatgggtcgacgaaccgacccttgatccggagctgaaagctgatcttaagaatatggctgatgatgagacgactaaggaagaggcatttgctgctcctatggcgtttggcacggcaggcatgcgtggtgttcttggtgccgggattggtcggatgaatatttacacggttcggcaagccactgaaggtttggcccggtttatggacacactgtcggatgaaactaaggcccggggggttgcgattagttacgactcccgttacatgagtcaagagtttgcttatgaaagtgccggggtcttgggtgctcatggtattaagagttatgtttttgatcagttgcggccaacaccggaattaagttttgcggtgcgtcatttaaagacctatgcaggcattatgatcactgctagtcataaccctaagcagtacaatgggtataagatttacggtccagatggcgggcagatgccaccggaagaatccgacaaaatcaccaaatatgctcgttcagcagcggatctttttgctatcaagtctctgaacgtccatgtgctacgcgccaaaaagttgatgcaaccgattggtgaagatgttgatgaagcttactatgctgaagtggccacggtcaccatcaaccatgatttgattaacaaagtcggcaagaacatgtcgttggtttatagcccactgcacgggactggacgaattccagcgcaaatggttttgcgtaatgctggtttcgaaaacttccggttggtgcctgagcaaagtattgctgatccagaatttgcaactaccccattcccgaacccagagttcgctcaagtctttgatttgccaattgcattaggtaaaaaaatcggcgctgatgtcttaatcgcgactgatcccgatgctgatcggctgggcacagcagttaaagtcggcgaccattatcagttgttgactggtaaccaaatcgcttcggtcttattgcattatattctggaagcgcgcaagcaagctggcacactgccgaagaatggcgcggttgtaaagtcaatcgtgtcgacggaattggcaaccgccattgcgaaggattatggcgtggacatgatcaatgtgctgactggtttcaagtttatcggtgatcagatcaagcattttcaagctactggcgagcacgaatttctgtttggctttgaggaaagttacggctatctgatcaagccattcgtgcgcgacaaggatgcgattcagtcaacagtgctgctggctgaagttgccgcctactatcagtcacaaggcaaaacgctttgggacggcgttcaggaactgtacaagaagtatggttactatgctgaaaagactgttggcgtcgattttgaaggggttgacggtcagaagcaaatggctaacttgatgaccaagttccgcgaagaacagcctgctgattttgcgggtgtcaagattacgaaggttgaagacttcctgagtcaggaagctaaatctgctgatggcactgtcgaaaaactgaccatgccatcaagcaacgttctgaagtacattttggcagacggtacttggattgctatccggccatccggcaccgaaccgaaagttaagttctatgtcggtaccaaagcagacacagaagctaaggcccaagaaaaattggatgccttcgaaaaggcgctcaatgattttcgtgaagaagcttagtttgttttaaacgaatcaatgtgtgaatcctgacgattaagcaggtgaagcaagatagcggcgaacgtattgtcccaaatttgggacaaggcgttcgccgttttccgtagggactatccggactttttcggtttctaaaagcgattgttcaaggtcctttaaaaaacgttgtcatccccacagccatgtttctccggtatactttaatcaaggtaatgatacgggggtggcatgatgaactatttaatcgttgaagatgaaccggcattaggcgagacactgcgcgcctatttggccaaagacggtcaggccgtgctggcgacctcgttagcgcaagccaatgaacgagtcgcgcagatttcgcccgatgtcatcattttagatctaagcatgcccgatggtgacggcttgacttggttagcgcaatggcggaagcatttgactgctaaggtgattgttttgacggctaatgacgaggagctaacgatgctaaaaggactccgacttgctgatgattacgtggtaaaaccggttagtttacgtgttttaaaggctcgcattgctaaacagctgccgatgacagtgcaacaatttggggcggttagcctgaatttagccactggtcaagtgacgaaaaatgagacagcggttgtgctaacggcggccgagtatcgtttgctggcctatttttttgccaaccccaatcagattttggcaagagatcagttgctagcagccttgtgggacacgcgtgagcagtttgtggcggataatactttaaccgtgaccatcaaacgcctgcgagaaaagcttgaagatgatccggcacatccgaccttaattcggactgtgcggggaatggggtattttattgatggttaagcatgattattgggctatgccggaaaccaaaagtgtgctgagattgacagtgtggttgatagttattttgtgggccgctttactcacggtgatggtgcttgtgccagtcactcggctttggctagttgttattggccttggcagcacactggccagtagttggatcgtgttgcggtgggcagtcaagtttagtcagcgtttttacttggcgctgcggcaacttgatctcacaaaggcaggcgcaagcaactatgcgattgatcggaatgatgaaggactgttttccgatctcaacaatcgactttatcaatatgcccgccaaatgcaggctgaacgcacggcagtgaagcgtgatcgcgatcagctaagtgttgctattaccgatattgcgcatcagttgcgaacacctttagcggcgaataataatttgcttgaaatgatgactgcggctaattgggaggtcacccgtcaggagcttttagcgcagcacacgcgtcaagcagagttagttgagcagctcattttattagctaaggtggatacacatacgctgagccaaactagacaagatgtgagcgtagcggcgctggggaaagaggcattgaagccactgctgcgaatggttgctgataagcagttgacgattgattggcaggtatcaccagacctaatgcttcatgtgaacccggcattggtcaaagaagcgttggtcaatgtcttgaaaaatgcggttgaacatactgcttttggcggtcaaattcagattattgggattgctgatcctattcgcgtccgcctgaagattatcaatacaggctcaccaattgctgaagcagatatgccgcatttatttgagcgttttttccgtggtcaatatgccactgccaataacgtgggcattgggttagcgattgctgctggcattacgcgtgaaaacgatggccgcttatttgctgaaaatacggcggaaggcgtgcaattcacgtttgaattttttcgttgagtgtgttttgtcacttacttgtcacttaccattgataggctgagagtatcataagaaagccaacacagattgatgtgtcaggcgcgaggaggggtactagtggccattttgacagcacgacaactgacgaagcaatatgcaggggaaagtcgaccagcgttagatcacgctgattttagtattgaaaaaggtgaatttgtggcaatcgttgggccgagtggttcgggtaagtcaaccttgctacatctgctgggcggtattgatcaaccaaccagtggtcgggtacagctatacgatacagatatttatgcgttgaatcagacgcaattagccatttttcggcggcgacaagtcgggttgatttatcaattctataatctgattcccgatttgacagtggtcgagaacatgacgctgcccgctgacttggacggtcgaaccgtcgcgacatctgagttgacagaattactggctactttgggtctgacggaaaagcaagatgctttgccaaatcaactgtcaggcggccaacagcagcgcgttgcgattggccgggcgctgatcaatcatccggcgatcattttagctgacgaaccaacgggcaacttggatcgccgcaattcacaagacatcatgactttattgcgccaggcgaatatcaagcaagggcagactttaattgtgattacgcatgatcccgatatcgctaagcaagcagatcgcgttgtaaccatcaatgacggtgtgctgcgtgaagggcggtgagcgtcatggggacgatgacccatttagtttggcgtcaactgattaaggagaaggcgcgcacgttcacaaccattctggcgatggcagttgctgcgaccttaactgtggccaccttgattggcattaattcggctcggcattcaatgtatcaagataatattcaaaataccggcggcctacagtttgttttatcgaaggttaaccaagaaaccgcactggctattcagaaaaaagccgatatttccgaaagtgtccgctatcagcaacaaggacaaatcagctttgctgatcaggtacctaaccaaccagattcgcctttgttaatgttgccgaaaccggcgctgcagcgattaatccaacccattcttttggaagggcggctaccccaaaatgagcaagaagtcatgttagcccaagatttgatttctgatgtttatgcagtgggcaaaaccgtggcggcacagcgcaatggtcagcgcgtcgttcttaagatcgtcggtagttaccgtggctatgctggcctcatggcaagtgatggcgctgtcaccaccggccattttgacggcacgaagaactatgctgtcgcagcggcttttggcaactatggcaatttttacgcgaagttgaagaaactcacagcgcagtatcatgtcggatccgaccagcagagaatgaatgaattagctttggaacgggccggtgagtcgcgagatgtcaaggtccgtgccatgttcgtattacttgtcatcgtggtgctaagtgtgattggtttggtgtcattggcgttgatttataccagcatcaatctgagtgtacaagcacaaacgcagcgttatggcttattgcgttcaattggtgcaacgccgagacaaatccggcaatcggtgtatctgcaagcactgactttggtattgccagcgattttactgggtttgcttgcaggaatcggtgggttgtcactcgcttttcatgaattgaatcgaatttttaaggcgagtggtaacacctttcagctcctactcacgatcagttggtggccgattttagtcagcggatttttcatgttgcttgtcacgttactagcagcacgacgaccagccaaacgcgccgcacaagtgagtccgattgccgcagttcgcgcgcagtcagcaagtcggaaggtgagtcagcgtatgttacggcaagggatgctgggacgatttttgccgacgccgattgctaaattggcttataaacattatcggcgtttgggctggtcaaaagtcacgatgatgacaacgctggccttgtcactcatgatctttatcggctttaccagtttctttcgcggcatgttaacttttagcgatgaaacgattagtcgccaggcagatgtgacgatcaccaagacacaatcgctggcatcagcgaatttctcttttaatccgaggcgactgccaggggtgaaacgcggaacggtgactggcacaactcaagtcggtttgaaaaacgctccacaagcatttcatgatcggctgaatgtgatcgtggtgagtgaccaaacgttcggcactgtttttaaagatcagccgacgattatcacaggcagtcggttagtgacgaactcaaaaacaggcaagcgccagcagcaatgggacacgccaaaagattttgcaggaaccttggagcttgctaacgagcaaagtagccaaaagactttaacgcagccgatgaaggtcgtcaccaagactgctgcggaaatgaccgattggcttgtcagtgaccaaagtggtttggtgctttctgctagccggttccgtcaaatcagccaagcactccaaattaaaaatgatgacgtcacgtatgccattcaagtcttactaattaaaccaagttttcatgagacggtggccagtgctttacggcatgaagtgccacatgcagcactttttgatcaaattgaaaatgatgcgcgtggcagcagctttcagcttgctattcaagtcatggtctatggctttttaaccctgctgacccttgtgagtctggcgaacattgtgaatcatatttttgctaatctgttgcaacggcggcgaagtctcgccatgctgcaaagtgtcggtacgacacctggtcaaattgttcggatgttggcacttgagaatgggtttctgtttgggacaagtatggtgattggttctttgctggggacactgcttggctggattctgcatcaagctgtcaacaccggtattacgatggcttttcaggttccttggttagagatggggatggccggacttgcattactggctatctggggtatttttgcagggattagttttcagattatgcgacatcaggatattgatcaattgattcgggtgggttaagacaaaagtgaaatgattgatggcactgatgctccggtttctaaccggggtggttcacgctcttgctgaaacgcgttctcaggcgcagaaacctgcacataaggacctcggacataaatggccaaagcccagccatttgtgtccgaggccacttatgctccggtttctaaccgcgcctgatcacgctctgctcttgcaatgggcttcacaaggtggtagtcttttaacaatttaatttactgccatcactatcacgccacgaatatcaggaggtcatttaatcatgggcatgcaccaatttatccaaggactaagcaacttagagacactgcgtcgggcaccgggattctttaagtatcaggaacattcagtggcggcacatagtttcaaagttgccgaaatcgcgcaaatgctaggcgatgtcgaggagttagctggtaacaaggttaattggcagatgctctatgagaaatctctgaatcacgattatactgaacgttttatcggcgacatcaaaacgccggttaaatatgctaccccgacactgcgccacatgctggctgatgttgaagcgaccatgacggagaactttatcaaaaatgaaattccccgtgactttcaggatcgctatcgtcgtcgtctttctgaaggcaaggatgaaacgcttgaagggcagatcttgagtgttgctgataaaatcgatctactatacgaaggttttggcgaaatcgagaaaggcaatcctgaacaggtttttctggatatctactccgaaagcttaagcacgatcctgcagtttcggaatcgtcctagcgtgcgctacttcttggaggaagtgttgccggacatgcttgatgaaaaatttgccagccgcgatcagcttgctaaactgactaaagaaaccatggcagaacatgaaccaaacaagtagcgaaagtatgttcgctatgttataataagcaagacaaaagttggaatgcgcatcatgtcgattccaacttttttgatgacgaaattttgtttggataatgtaaaaatgcgttcactggggcctttttcctgcacggattgacacgtgttcaccttgtattcggaatgaatgatgcccatgtgattgttttataggaggcatgtcgatgatcgaacgaatagccgatcgtaaatttgatctggtttcaccttaccaaccagctggtgatcagccacaggccattgccaagttgacaaagggctttgaagagggtaagaaagaacagatcttgttgggtgcaactgggactgggaagacctttacgatgagcaacatcatcgccaacttgaacaagccgaccttgattttgtctcacaacaaaacattggccgggcagctttatggtgaattcaaggaattcttcccgcataacgcggttgagtattttgtttcctactatgattattatcaacctgaagcctatgtcccgagtaccgacacgtatattgaaaaagatagtgcgattaacgacgaaattgataaactgcggcacagcgccaccagtgcgttgttggaacgaaatgatgtcatcgtggtggcctcagtgtcgtcaatctttggtttaggtgatccgcatgaatacaaaaatcatgtgctgtcattgcgaactggcatgacgattgatcgtaatacactgttacgccaacttgtagatattcaatttgatcgaaacgacattgattttcaacgtggtcgctttcgagttcgcggcgatgtcgttgaaattttcccggccagtcgtgatgaccatgcgattcgagtcgagtttttcggtgatgaaattgatcggattaccgaagtcgacgcattgaccggcgaagtcatcgggacacgtgatcatgtggcaattttcccggcaacgcatttcatgaccagcgatgaacagatgcagcgagcgattaagagcattgctgctgagttagaggcacaattgaaagtcctgcgcagtgaaaacaaactgttggaggcgcaacggttagagcagcggacgaactatgatatcgaaatgatgcgggaaatgggtttcaccagcggcattgaaaactattcacgccatatggatggccgtaagcctggtgaaccaccgtatacactgctggactttttcccgaaagacttcaacattatggtggatgaaagtcatgtcaccatgccgcaaattcgcgggatgtacaatggcgaccgagcgcggaagcaaatgctggtcaactacggcttccgtttaccaagtgctttggacaaccggccattgaaaatcaatgaatttgaacaacatgtccatcgtattttatatgtgagtgctactcctggtccttatgaactggatcgggttcctaaagacgatattgctgagcaaatcattcggccaaccgggttgttggatccgaagatcgaggttcgaccggtcatgggtcaaattgatgatcttgttggtgaaattaacaaacgggttgatgctcacgaacgtgttttcatcaccaccttgaccaagaaaatggctgaagatctgactgactacctgaaagacatgggcatcaaggttcgctacttgcatagtgacatcaagacacttgaacggacgcagattattcgtgatctgcgacttggcaagtttgatgtgctgattgggattaaccttttgcgtgaagggatcgatgtccctgaagtttcgttgattgcaatcttggatgctgacaaggaaggctttttgcgtgccgaacgttccttgattcaaaccattgggcgggcttcacgtaacgagcatggcaaagtcatcatgtatgctgataaggtgacagattccatgaaggctgccattgatgaaacccaacgtcgacggacgattcaggagaagttcaacaaagaacatcacatcacgccaaagaccattatcaaaccgattcgggcagctatttccagctatgaacaatcagatgatgataaagccgaggccaagaagacttttgctgaagttgattatgaggatatgagcaaggctgataagaaggagttagtagcaaacctgcgctcccaaatgcaggcggcagctaagaagcttgatttcgagcaggcagcgtcattacgcgacacaattcttgaattgcaggctgatatgtcttaatcagatcgcacttgcacgatggtaccaagtcagccatgattgctttgaacagatccggtgagcgcgaaccagcccggttagaaaccggagcataagtggtcttgaacgtgatggccggtctttggccattgcgttcaaggtccttatgtgcaggtttttgggctggcgagcacgttaaggtgagcggtcagaagtcggcgtataagctgttgtggcaatgtgattttcgccaatactgcttgctaaaaatgaggagatcttttgtgaatggcaaacgataaaattgtgatccatggggctcgtgcccacaatttaaagaatattgatgtgacgattccccgcaataaactggtcgtgatgaccggcctatctggttcaggtaagtccagtctggcttttgacacgctttacgccgaaggtcagcgtcgttacgtggaaagtctctcagcatatgccagacagtttctgggacagatggaaaaaccggatgtcgattcgattgacggcttaagtccggcgatttcgatcgatcagaaaaccacttcaaaaaatccccgatcaactgtgggaacagtcactgaaatcaacgattacttgcgcttgctgtgggcacgtgtcgggcatccgatttgtccaaatgatggcacaccgattaccagtcaaagtgttgaacagatggtggatcgcgttttagccttacctgataagaccaggattcaaattctgtcaccagtggtgcgtcgcaagaaaggcagtcataaaaaagtcttcgccaaaatcatgcgtgaaggttatgtccggatgcgtgttgatggtgaagttgttgatgcaacggctgattatgaactggataaaaataagtcgcatgacattgatattgtgattgaccgaattgtggttaagcctgaggcgcgcagtcggcttttcgattcatttgaagcagctctgcggttgtcagaagggtatgccaacgtggacgtgattggcggtgaaccactgcgcttttccgaacattttgcctgcccgatttgtggctttacgattggcgaaatggaaccccgactattttcattcaacgctccttttggcgcttgcccagaatgtgacgggttgggtgttaagctgacagttgacatggatttggtgctgccagaaccgagtatgactttggcagaaggggcaatcgcgccatggaatccaatcagttcccagtactatccggaactgctggctcaggcggcgaaaaccttcaaggtacgaatggacgtaccctttaacaagctgacccaccgtgagcgcaatgtggtgcttaatgggagcgacggcaagttattccattttcattatgaaaatgactttggcggtgtacgcgatgttgatgtaccttttgaaggggtgctgaataacatttcccgccgatatgcagaaacgaatagtgattttactcgccagcagatgcgcagttatatgacagcattgccgtgcccggtttgtcacggcaagcggctgaatcggcaggctttggctgttaaaattgaaggtcgcgatattgcagaagtttctgatcttgccatcaaggatgccctaccatttttcaaaaccgtgcatcttagtgaagccgaaagcgtcattgcccaaccaatcgtgaaagaagtcgttgaccgcttgacattcttggtcaacgttggtcttggttatctcacattgagtcgtagtgctggtacactatccggcggcgaggctcagcgaattcgcctagctacccaaatcggttcgaatctgagcggcgtcatgtatgtgcttgatgaaccatctatcggcttgcatcagcgcgataacgatcgcctgattgcctccttgaaaaaaatgcgcgatcttggcaacacgttgatcgtggtcgaacatgatgaagatacgatgcgcgccgccgattatctgattgatgtcggaccgggggctggcgaacacggtggccgtatcatggcatccggtacccctaaacaagttgcacgtgtgcgcaaatcaatcactggccaatatttatcagggcgcaagtttattccggtaccactaaaacggcgacaaggtagtggcaaagtgattcgtttggaaggcgccactgaccacaacttaaaaaacatcgatgttgattttccattaggtaaattcatcgtggtttctggtgtttctgggtcaggtaaatctactttggttaactcgattcttcggcgtgcattggctcaaaagttaaatcataattctgagaaaccgggtccatacaaaaagattcttggctataaaaatattgaaaagctgatcaatattgaccaaagtccaattggccgcacaccgcggagcaatccggctacctatacgagtgttttcgatgacattcgcgggctatttgccgaaaccaacgaagctaaattacgtggttacaaaaaaggccgctttagtttcaacattaagggtggtcgctgtgagaactgtaaaggcgacgggatcatcaagattgaaatgaactttttacctgatgtttacgtgccttgcgaagtttgccatggcaaacggtataactctgaaaccctcgaagtaacatataagggcaagaatattgctgaagtgcttgatatgactgtcgaagaagccactgacttcttcaagaatattccaaagattcggcgcaagttgcaaaccatcgtggatgttggccttggttacgttaagctgggacaaagcgctaccaccttgtctggtggcgaggctcaacggatgaagcttgcaagcgaactgcagaagctttcaaccggcaagaatttttatattcttgacgaacccaccactggtctgcatacagatgatatcaagcggctgctggaagtgttggaacggctagtcgatgaaggcaataccgtactggttatcgagcataatctagatgtcgtcaaaacagctgactgggtcattgatcttggccctgaaggcggagacggcggcggacagatcatcgccactggcacacctgaacaggtggctaatgtggccgatagttatactggccaatacttgaaaccaatcctcgttcgcgacactcaacggaccaaggaagctgcgcaaacatcaactaagaatgaagcgcaggcagtaagcaagaagtagattgactgaccaggttgggccatcattcacggcggttaataagggcaaacaatgacaacaaaattgtttgcctttttgatatgggaaatttattagaattttcgagacactagtaccaaggcggagcaatcgtagaccggatggggatcagcagtacaaaaagcacggcgaccgcgccttgtcactgatgttgttaggcgacttcgagaccgcgagctttgcgggcttggagcgttgtctacggtctagcaacgcgtcgccagcccagaaaccgagttgtttcacactctgatttgctcattctcgtgcttaatattatgatgaataggattaagaaagtagggaaatagatgttaaatcgaaaaagttttggttttgactgggggcagtttatcactggtatcctgttcctgatcgccgcatttgtcgtcatgcgctatccgctggcaacattgaaaacggtgacctttatctttgctgttgttgccattattcgtggggttgcgattttagcagggtattcaacgcttcgccagctcactggtaaactagcttgggtgtcgctcttgatggggatttttgaccttgttattggtgtcattttcctggtcaacagtaattttggtgttgcaacgattaccatgatgtttgcaatctggttcttagttgattcagttggttcgctattcaacgtgggccatttgcggattgcaggtactggctggtttgtcctttacctcgtcttggatattctggcagtgattgtgtctttgatgttgttcatgcagccagtggttgcggccatcacattggtcacattattgtcgatgtttttcgtcctattcggcatcgaatgtattgtccttgcctttgcacgacgcaatatttaatgaacatcgcttttatttaacctgatgcagctgattcattgcgctgcatcaggttttttaataacaacgcttgatgatgcggtgaaaagaaaccggggatcggtaggaatgacacgcccggcatgttatacttgaataaatatgatcaaaaaggagccttttatgactgaaagtttggatcttgtcattatcaccggtatgtccggtgccggtaaaaccgttgccatgcaggcattcgaagacctgggatatttttgcgtagataatatgcctccagctttgttgccgaagttttgggaattggtaaaagaatccggaaagatcacgaaggtcgcgcttgttgtcgatctgcgcagtcgtgctttttacgatcagattatcgatatgctggctaatttggacaacaatgcctatgttcattctcgcatcttattcttggatgcaactgatgaagagctggtttctcggtacaaggaaacccgtcgctctcatccgttggccatggaaggccgattgatggacggcattaaaaaagaacgtgcattactcacagaattgcgcaatcgcgcgcaggttgtgattgataccacgaccttaagtccacgtcagttacgggaaaagattttccttaactttaaggaaagcggtagtcaaccagcatttcatattgaagtcatgtcattcgggtttaaatacggattaccaatagacgctgatattgtcatggatgtccgtttcctgcctaatcctttttacattaaggattatcggcccaagactgggcttgatccggaagtttacaattacgtgatggataatgaagatgccgaaagtttctataacaagttttatgatctattgtctgaaatcatgccaaagtacaaggcagaaggcaaaaccagcgtaacgattgcgattggctgcacaggcggccagcatcggagtgtggcttttgccgagcggattggtaaggcgttttcagatgcatatgccgttgatatcacgcatcgagacattaagaagcataaggagacggtgaatcgctcatgagtcgtgaaactaaatttattcgggtcatccgcggtcggcgtccaaaggtggttgtcattggcggtggaacaggcttgccggtcattctgcatagtttgcatgagcaagatgcagatgtgactgcaattgtgactgttgccgatgacggcggttcatcagggacaatccgcaactatatcaacgtagtgccgcctggtgatattcgcaatgtgctagtggctttatcggagttgccgagtttgtatttggatatttttcaatatcggttcaatacaactgatgcttttttcgctgggcatgcgattggcaatctgattattgccgcgctgtctgaaatgaaaggcggcattttcccagcggttcagcaactaagcgaaatgatgcaagttgatggtcacgtttatccggccagcaacacgccgttaaccttaaatgctgaattcaccgatggtacaaagctgtctggtgaagctgagattacagcggctgggaaaaacatcaagcatatttcggtttcagaaacagatcccgccaatggcaaaccagaggcggtcaaagaagttatcgatgcgattatggacgctgatgttgttgttttaggcccaggcagtcttttcactagcattttgcctaacttgatgattgaaaatctgggggatgcggtgaagaagacgcaagccgaagtgatttacattgtcaatatcatgacccaaaaaggcgaaacccagcattttaccgatgccgatcatgtccgggttctgaatgaacaaatgggcgagaactttgtggatacggttttggttaacattgaaccagtccccgataattatctggatcatcaaaagtacaacgaaattctcacgccggttaagcataactatcaaggcttgcgagacatgggctgccgcgtgatttccgaagactttttaaagttgcgcgatcatggggtctttcatgatggtgataaagtcgccaaggagattttaaacttggcctttcaggtcagcggcaaaacccggaggtgagggtatggcaagtttcgccagtctggtgaaaaaagaactgacacagctcgaggtacatccagaacatgctaaggctgaactgtctgctttgattcgtatgaacggcagcctgacactgatggctcatcgttttgtgttaaatattcaaaccgaaaatccggctattgcacgtcggatttatagcttgattcgccaagtctatcatcacgaagctaatctggttgttcaccgtaagatgaagctcaagaagaattatcaatacattgtgcggctaacagaaggcgtcaatgacatcttgtcggatctatcaattttagatccggataccatggcgatttcaacaaccgttccagcttcggtgttgaaggaaccgcagcggatgcgttcttatttacgcggtgcctttttggccagtggttcagtgaataacccggaaacctcgcgttatcatctggaaatctattctttatacgataatcacaatgctggtattttgaaaatgatgaatcattttaatctgaacgctcgcaccgtagaacggcgaagcggctacattgtttacctcaaggaagcagaaaagattgccgatttcttgcaggttattggggccacgaatgccatgctgaagtttgaagatgttcggatcatgcgggatatgcggaattcagtgaatcgattagttaactgtgaaaatgcgaatatgaataaaacgattgacgctgcacagaagcagattgagaatattaactatttaaagaaccatgttgggctagataacttaccggccaaattgcgggaaattgcagttttacgtttagcacatcctgacgtctcgcttcaagagcttggagcgatgatgccgagcggccaaatttcaaagtctggggtcaatcaccggttgcggaaattgaatcagattgctgaagggtatcaacaaccagaagacgcttgagcactaatgcgaagtgggttgcgttcatcataatcgggtgttgacaatcaacaaatcaatccctttgtttcctcaagctaatcgtgtacaatgtaaccgacatcaagttatttttttgctgaagattgactgttttggacgcatgtcgatgtcttttagcttggatgtatccctttggcgacgacttgtttgaaggagccgtgatgatcttggcaaccagagagaagcgccatcgcttttttgagatgaccgtcttgaagcaatgacgtgagccccgtcggtgttgatggtggctaataattgatagatgaacgcatttttcacagtgtggacggcttttgcgagctgttcgcgcgtttaaaggtaagttttaggaggaagcagcatggttaaaccgattactttgaacgaacagctttgttttgcgatttacaaagcacaaaaacaatacaatcatttctattcacaagcgctagctccgttcaagttaacctatccgcagtacatcacgttattgtcgctatatgaacatggcacaatgtcggttaagcaagtcggacaaacacttgaactggatagcggtaccttgacgccgttaatgaaacggcttgaaaaagatggctggatcagtcgcaagcgttccactgaagatgaacggcgagtggatgtcagtttaacccaaaaggcgctggatgcccgtgatcagatttttgaacacgttggatcttgcatggagttgatgaatcttcctaagcctgagtatgatcatatcaagtcagaagtcagtcgggttgatgagcatttaagtgccattcccgacggcgcttttccagaagcgtaacgcccaaaaataaggtcaaagatttttacctaaatctttgaccttatttgactttagttgtatacttagcactgtacttttaagagtgctaataacgattatcaggaggttaggacatgctagtacctaccgtcgttgaacaaactagtcgtggcgaacgtgcttacgacatttactcacgtctattaaaagaccgaatcattatgttatccggtgaagtcaatgatcaaatggccaattctgtcatcgcgcaactgcttttcttggacgcgcaagactctgaaaaggatatctatctctacatcaacagtcccggtggtgttatcaccagtggcttggcgatgctggatacgatgaacttcatcaagtcagatgtgcagacgatcgccatcgggatggctgcctcaatggcgtccgttttgctggctggtgggacgaaagggaagcggttcgcattgccgaactcaaccatcctgatccatcaaccttcaggcggtgcccaaggtcagcagaccgaaattgaaatcgctgctgaagaaatcttgaagacacgtcgcaagatgaaccaaattttggctgacgcaactggtcaaacgattgagcaaattaagaaggacaccgagcgtgatcattatatgagcgctcaggaagccaaggattacggcttaatcgatgatatcttggtcaacaaaaatacgcaaaaataagctgtaaaaagaaaagcgcgttgccatatcgtggcaacgcgtttttgtttccccgaaaagacttgcaaagcgagggcatattgagtaatataattaggtacttgcgcggttagtgtaatggatcgcacgtgagattccggttctcgaaatccgggttcgactcccgggctgcgcagaaacccggttaaatgggaaaaggtaggacagcataaccccgagtaatcggggtttttgttttgtttaaaattaaaaacattcaaaacaggatagaggcgtgacatgcatcatgctaaaacgccgataagtgatagcctgagatccgaattgcagcgacgatcttcaccgttcattgctcgggtgcttgatgagagattcggcggctatttttgcaaacgctaacattatgacttggaaactgctcattatataacgaacgggaataaaaccaacccttgtcactactgaactaagacacaaactgaatcacttttcccagcatgaaaattccattagaaacaacccgaaacccgctttcaaaaaaacccgccagacgggatgatgttttagtaaaatccgaataatcttcacaccaaaaaaatagatgttctaagtttaccgaatatgtgattgtttttggacgattaaggccgcagacttgcgataaagcggaacccctgctacaattggtcttgttggtaaaggaaaacagcatttgttgggttcctaatttttttcagcttgctgggtcggcgaacgactcggagggacgtgaaatgacccattaaagaaggacgtgccttatgcatactgaacttgcgtggctcaaagcgatcgcgcctgatctgatgggcgttgtcactaaacgctatcaggtccttcaatttattaactggatggcaccagttggccggcgaacgttggccgaacagatgaagatctcagaacgtgctttgcgcacagaaacggattttctgcgtagtcaaggtttgttggaaagctcaaaatctggcatggtgctaacagcaaaagggttagagacatttcatggccttgatcatcttatgaatcagctgttaggaattaaggatgatgaaaaacgacttgctgcccagcttcaaatcgatcattgtttggtcgtatctggcgatgccgatcaaagtggtcgggtgcttgatgagctggggaagacgttgaattcgaccttacaattactgttgccgccgggtcgcttgacggttgctgtgatgggtggaacgacaatggcacatcttgcaaggcagctgacatttcagttgtctgcaggacgtgaattgacgtttgtccctgctcgcggtggcttaggcgaagcggtgacgattcaggccaactcgattgctgctgcgatggcggaagcaaccgacagcaactaccgagcgttgtatgtaccggaaaatcttagctcggaatcctacgaatcattgattaaagagccttctgttaaagaggttttagggctgattgataaggctcaggtcgtgattcatagtgtgggtgacgctttagtcatggctcgtcgccgtggcatgtcatctgacacgatcagcatgttgaaagccaaacatgccgttgccgaagcattcggtgttttctacgatgcgagcggcaaggtcgtttacaagataccgcagattggtttacagctcgcggatcttgatcatataccgtatgtattcgctgttgctgctggcaaaagtaagtccaaagcaattgcggcatatatgcaacacgcaccgagtcggacgtggctgttaacagacgtcggtgcaactaattcgattttaactggggcaacccgttagaataaaaccttatttcctaaaggaggaaattttagcatgactgttaagattggtattaatggttttggccgtatcggtcgtttggcattccgtcgtatttacgaattgggtgcaaagagcaatgacatccaggttgttgcaattaacgatctgaccagcccaaccatgctggctcacttgctgaagtatgattcaacccacggtactttccctggtgaagttagtgcaaccgataacggtatcgtcgttgacggtaaagaataccgtgtctacgcagaaccgcaagcccagaatattccttgggttaagaacgatggcgttgactatgttcttgaatgcacaggcttctacacctctgctgaaaagtcacaagctcatttggacgcaggcgcaaagcgtgttctgatttctgccccagccggcaagatgaagaccatcgtttacaacgtcaacgatgacactctgaatgcagacgacaagattgtttctgctggttcttgcacaaccaactgcttggcaccaatggcttacttcctgaacaaggaattcggcatcgaagttggtaccatgaccaccgttcatgcttacacctcaactcagatgttgcttgacggcccagttcgcggtggcaacctgcgcgctgcacgttccgctgctgctaacacgattcctcacagcacaggtgctgctaaggctatcggtttggttatcccagaattgaacggcaagttgcagggccacgcacagcgtgtttctgttgttgacggttctttgaccgaattggtttccatcttgaagaccaagaacgttactgctgaccaagttaacgaagctatcaagaagcacaccgaaaacaaccctagctttggctggaacgaagacgaaatcgtatcttccgatgttatcggtacgacacaaggttcaatctttgatcctacacagaccgaagttacaactgctggtgactatcaattagttaagacggttgcttggtacgataacgaatatggctttacttgccagatgatccgtaccttgctgaaatttgctactctctaatccggagtaacgcttttctagccgcaacatccgaagcggagggagcttactccctccgctttttttggaaataggcgatcaattctcaggatgttttagcatcctgctgaaaacgagcgcttatttctggtgttaagcggtcgttacttgaagttaagtcatctttaggaaaaataggaggtcatttctcttggctaaattaattgtttcagacttagatgttaaggacaaaaaagtcctgatccgcgttgacttcaacgtgccgatcaaagatggtgttatcggtgatgataaccggatcgtggcagcattgccaaccatccagtatgttattgatcatggtggcaaggcaatcctcttgtcacatctcggccgtgtcaagaccgaagaagacaaggctaagctgaccttgaagccagttgcagaacgtttgagtgaattgctgaagaagccagtgacatttgtcccggcaactcgcggcaaggaacttgaagatgctatcaacaagatgaatgatggcgacgttcttgttatggaaaacacccggtttgaagatcttgacggcaagaaagaatccggcaacgatcctgaacttggcaagtactgggcaagtcttggcgacttattcgttaacgatgcctttgggactgcacaccgcagccatgcttcaaacgtcggcattgcttccaacatgaagcaaactgctgccggcttcttgatggaaaaggaaatcaagttcttaggcgatgccgttgacaacccgaaacacccattcattgctatcttgggtggtgcaaaggtttccgataagatcggcgtgatcgaaaacttggtacctaaggctgataagattcttatcggcggcggcatgacctatactttctatgctgctaagggtatgagcatcggtaagtctttggttgaaaaagacaagatcgaacttgccaagaagatcatggatcaggctggcgacaagctgcttttgccggttgattccgttgttgcaactgaattctctaacgatgccccacataaagttgttgacggcgacattcctgatggctatatggccttggatatcggcccgaagacaatcaaagaattcaaagatgctttgcaaggtgccaagaccgttgtttggaatggcccaatgggtgtctttgaaatgagcaactatgctgaagggacccttgaagtcggccgtgcccttggcgacttgaaggatgctactacaattatcggcggcggcgattcaacagctgctgctaagcaattgggtattgcacctaagattacccatatttccactggcggtggcgctagccttgaatatcttgaaggcaagaccttgccaggtatcgcagctatttctgacaagtaattgtcaggcatgctgatctaacagtcactaccggcagacggtgtctgtcggtacatatgaaaggaagatatgccatgcgtacaccattcattgctggtaactggaaaatgaacaaaaatcctaaggaaacgcaagaattcttagacggcgttaaaggcaagttgcctgatgcaagcaaggttgagactgtcattggcgcacctgccattgatttgaccaccttagttgctggcgctgaaggcacacctttgaagacggcggctgaaaactgctactttgaagacgaaggtgccttcactggtgaaaccagcccgaaagctttgaaagaaatgaacgttgattacgtcattatcggtcacagcgaacgtcgcggctatttccacgaaaccgatgaagatatcaataagaaggctaaggccatctttaagaacaatcttttgccaatcatttgctgcggcgaaagtttggctcagcgcgaagctggccaaaccgaagactgggttgcttcacagattgaagctgctttggccggtttaagtgctgaccaagtcaaagtttcagtcttagcctatgaaccaatctgggctatcgggacaggtaagacggcaactgccgatcaggcacaagaagttgtcgcacatattcgtgcaacggttgagaagttgtataataaagatacggcagatgctgttcgtattctttacggcggctctgttaaaccagcgaacgtcaaggaattaatggctaagcctgatatcgatggcggtttagtcggtggcgcttcgatggatcctgaaagtttcatcgccttggctaactaccaagattaatctgggttctactattaaacagccttctggcaaaaaggagaagaatttatgtctatcattactgatgtattggcacgcgaagtcttagactcccgtggcaaccctactgttgaagttgaattgtacactgaagacggcggctttggccgtgcgttggtaccatcaggtgcttcaaccggtgaacacgaagccgttgaacttcgtgatggtgacaaggatcgttttggcggcaagggtgttttgaaggccgttggtcatgtgaacaacgaaatcgctaaggcggttattggccttgacgtgactgaacaacgcctgattgaccaaaccatgattgaccttgacggtaccccgaacaagggcaagtttggcgccaatgctatcttgggtgtttccttggctgcagcccgtgctgctgctgatgaagttggcctgccattgtatcaatatcttggcggcccgaatgcccacgttctgccaacgccaatgatgaacgtcctcaatggtggtgcacactcaaccaacaccgttgacttccaggaattcatgatcatgcctgttggcgctaagagcgttcgtgaagctgttcggatgggttcagaaaccttccatgctttacaggcactgttgaagagtaaaggcgacatcaccgctgttggtgatgaaggcggctttgccccgaacttgaaggataacgaagaagccttcgaacttcttgttgaagcaatcaagaaggctggctacaagccaggcgacgacattgctttggcctttgacgttgctgcttcagaaatgtacgatgccgagagcaagacatacacaaccaagtggtctaaccctgacaagaagtacaccactgaagaatggaccgacatgattgatggttacattaacaagtacccaatcgtttctgttgaagatcctatcgacgaaaacgactgggaaggctggcagacattcaccaagaagatgggcgacaaagtccaaatcgttggtgatgatctgtttgttaccaacaccgactacctgaagaagggtatcgatatgggtgttgctaactccatcctgatcaagctgaaccagatcggtacattgaccgaaaccttcgaagccatcgaaatggctaaagaagctggttacacagctgttgtttcacatcgttccggtgaaactgaagatacaacgattgctgacttggttgttgcaaccaacgctggccagatcaagactggttcaatgagccggacagatcgtatcgctaagtacaaccagttaatgcggatcgaagatcaactgggtgcacaatccttgtacaagggccgcaagtccttctacaatgtgaaagcaatcgactaatttgcttaattagttggcagcttggaaagcacgtttccgttaaggagcgtgctttttttgtggagcgtgagctggcgcggttagaaaccagagtgtgtaagttcaaggtccttacatgcaggtttccgcgccagcgagcgcgtttaattgtgcgcgaacaggagcgcttagaagccggaacataagtggcttcgaccaaatggcgtggttttagcgaggtctcttgggttgaaagaatcaggattttttaatcggtgagactgaatcgcggttgtcgggtgcacctttctgtatactagggataagcacaaatgaaaggacagttttctatgcaaacgacgccacctcattggcaacgaaacattgctatctttttgcttggtcaatttctttctggcattaccagtatgacggttcagtatgcgatcatttggtacttaactgccaaaactggttctgcaacgattctcagcattgctactttattaggtatgttgccgacgattctgctgagtccttttgtcgggccttatattgatcgcttgaacaagaaaatgttgttgattgtaccggatattgtcgccgctatggtggcacttattttgagtgccgttggcgagtttggtggtttttttcctgtttggctgatctttgtgtcgttgctggtgcgggcgttggcacaaacattccagatgccgacgattcaggctattttgccaaccatggtccctggtgatcagttgacgcgcgtgaacggtcaactcggtgtggtgaattcggcgaacatgattattgcgccggcactcggagctgtcctttttggcctgatgccgatgccgcttttgattttgttagatgttttaggtgcgattctaggtgtcagcttgctgttgttcgttagtattccagaaaatcgcttggtcgggacaaccgtccatgttgcgcaggatgccaaggtcgggtggcaattgttgcgaggcaatcgtggcctgtggtatatgactttaattggcatgttgacgacgtttgccttcatgccagccgctagtatgtatcctttaatgaccatgcgttattttcatggcactgtcggccaagctggattgattgaagttgtttattttgctgggtcgctacttggtggattgctcattagcgtctttggccattttcgtgatcgtattcatccgattgtctgggggatggtggtcattggcgtgacgtttggattaagtggtgttttgccacgaactgaaaatggctttttatggtttcttatcttgaatggcgttgctggcttagcttggccgtttttcaacacgcctttgatcgcgatgtatcagcaaagttatgctcctgagacgctcgggcgggttatggggattttgaatgcactaatgagtttgccagggccggtcggcttgatttttgctggtcccatcgccgatcgctttggtgtcgcaactttatttgtagttgcagggatcggcgtgttactggccgctggcgttatgttcggcttgaagatcacccgcgaatatgaccgtcagttgcaagcagacgggtcatcagatttgactaaaaggggatagatcgtttgaaaaaatttttcaccgtgtttgcttggctagaagttgttttaggattgacgatgttatggatgacgtgggatgtcggcttgcgagcatctggccagatttttggcgccttagttgttttaatcgggattgtgcttttatacgggttgatcatttatgcgttgattggctggttcatggatcctacgcaccgttactggtatgtgctgacactggtgctaactttgctgtacaacgtgttagcctggacctttcccagcgtcatgatccaaacatgggccacatatccatttccgcttatcactttgttaatcggtgcaatgttggtttgggtggctcggcaagaaaaacaataattggttttgctgactcgggtgactgagtcgtttttgattcccagccagaggtatatactgagatcatgttgtactggaggggaattacttggcacgacctgtaaaagaaaaatttgacgttactcgcctgcgatttgtgctactcggactactcgttggtttaatgagcggcactgttgtcagcgcgtttcgctattgtattgaggtagggctgcgctatagtcggctggtatatgggcacttgcgaatagcaccgtttgtctggtggcaatgggcgttgttgatcggtgtcaatcttggtttggcgttgatcgtggcgtggcttctcaagaaagagccctatatttctggctctgggattccgcaagttgaaggccaattggctggtgaattggaaatgcactggtggtcgatcctctggcgaaaatttgtcggcggtgttctggcgctggggcctgggttgtttctcggacgggaaggaccgtcgattcagttaggcgcttcagtcgggcaaggtttagctgctgggttcaagctatcaggaactgatcggcgattgttaattgcatccggttctgctgctggcttggcggcggcatttaatgcacccattgctgggaccttgttcgtcttagaagaggtttatcataatttctcaccgcttgtttggttaacggcattggctggggcaattggatcggattttgtttcactgaatgttttcggacttgttccggtgctgcatttaagctattcgcgtagtttacctgtatcgagttattggcatttaattttgctaggcattcttttgggcttgtttgggtacttataccagcgaatcttgttggtgatgccgcggtggtatcgcaacttgacacatttaccgcggccattacaaggcattgtaccgtttctgctggtgattctggttggctattttgcaccaaacttacttggtggtggcaatggtttgattgtcggttttggccagtatgtgccatctttgcttgtattgatcgcaatttttgttgtacgtttcgttttttcaatgatttcatatggttctggattaccaggtggcatttttctgccgattctttctttgggtgccgtgattggtgccatttatggcgtcttcatgaatcaactcggcttattgccgcacgtctatatcatgaacttaatcattttttcaatggccggttactttgctggcattgggaaagcaccgtttactgcgattctattggtaacggagatggttggtaatttgacgcatttgatgccgttagcggtcctatcattaactgcttatctcgtggttgatttgcttggcggtgcgccgatctacgaagcgttactcgagcaaatgacaatgccgaaaacagttcagcagcttcatcgacccgaccgactggaaataccggttttcttcggcagtcccttgaatggcaaaatggtccgcgatatgccatggcctaaagaagcattactaatcggaatccggcgtggcgaacaggaagtgattccacatggtgattccttgatccgtgaaggtgatacgttggtgctgttaacggatgcgacccaacgtgctcgggtcaagcggcggattgatgcgctatcggcggcgttggggaaaacgcaccaaaactcatgagcaagttatctgtcaggacgttgacgtgctactattgtgagttattttacttgctgtgagacggttcaagtagctaaaaaggtggatttcagcaaagatgcctcttttaggtagaatgcgttcgcctttatgttgcttttatgctaaactactagggtgagatttttcgcaagggaggcaacaacttgcaaagtttattgaccacatttcttgtgatcgattcgattttgatcgtgatcgcaacattaatgcaaccaagcaaacaacaagatgcgttaagcgcattgtccggtggggcaacagatcttttcgggaagacgaaatcccgcggcttcgaagctttcatggagaaagtcaccgttgtactaggtgttattttcttcggcctcgcaatcgcgctggtatatctggaagcccattaacgaaagtctcctggtactcaggagactttttttgcagagcgttcattggcccggtttctgggccaggaaacgcgtttcgacagcaactgcggtggaatagctaaccatatgacaaggctgactttatccgccaatagacaagacctacaaccgttttttcaccgcaatatcgagccttttcaccaagagattgaagttccacttgtccacccagccacttgccacaaaggatgaaacccatcatgatctttcgtgaaccgcaaccattcgaatacgagggcactgataccggtgttgttttgctgcatgcctatactggcagcccaaacgacatgaacttcatggggcgggccttgcagcgggctgggtatggcgtgtatgcgccgttgttcacgggacatggtaccattgagccaatggatattctgactaagggcaacccagatatttggtgggcagaggccagcgcggctgtttcgcatatgacagcaaagtatgaccgtgtttttgtttttggattatcactcggcggtattttcgccatgaaagctttggaaatattacccggtgtcacagctggcggcgttttttcatcgccgatcttaccgggtaagcaccatctcgtgccagggtttctgaaatacgcacaatatatgaatcgtttggcaggtgtaccagacgaaagtactcagattttggcttacttaccaggccagctggcggcgattgacaatttcgccactggggttgccgccgatctgtatttagttaataagccgatctttatcggccaggccggtgctgatgaattagttgatgggcagctggcttatcagctacgggatgcactcatcaatgcaccgcaagtagattttcattggtatgacaatgccaagcatgtgatcaccgtgaattcggcgcatcacgcactacaacaagacgttatcgcatttatgcaacaagaaaacgagggatagcatgaccacagttggccatattcgtaatgaacttttagcaacatttcgtaaaaatccgaagattgattattcggtccagacgctgagccgtgccttgaaattaaacgaaggcactgattttaaaacgctggttcaagccttaactggtatggaaaatgacaatttaatccatcccattagtgaaggccgttatgcttggggcggcacgcctaaagtgttgacaggtattttccatggcaatgaaaaagggtttggtttcgttgcgattgaagatcaggacaatgatgtttatgtgccgtcaacgagcactgattttgctttggacggtgataccgttgaagtccgtatcgtccgtgaagcacgcccaaacgatacgcgtggaccagaaggcgaaatcactaaggttgttgaacgcagcctaacgacacttgtaggcgaattcaaaccattttccgacaaagatcgggccaagtctggttttattggtatggttgtcagccacgagaagaaactgaagaattttccggtttatgtcaaagacactggtaccatgccgcaattaggcgacatgacggttaccgagattacggaatttcctaatgaacaccatccgaagctgatgtatggcatggtggttgaaacattgggaaataagaatgatcccggtgtggatattatgtcattagtgatgcaaaaccatatcaagactgagtttcctgatgaggtaatgactcaaactaatgatatcccggatcatgtcaccccagaagaacgggtgaaccgtaaagatatcaccgatcaagccgttgtgacgattgacggcgacgacagtaaagacttcgatgatgccgttgtcgtttggaaattgccaaacggaaacttccatcttggtgtgcatattgcagacgtgtcgcactatgttacagaaggctcagcgttggacaaagaagcgtttgatcgcgggactagtacgtatctggtcgaccgtgtcattccgatgctgccattccggctgtctaatggcatttgttcgttgaatcctggcgttgatcgcttggcgatgtcttgtgatatggaaattgatcaagatggtcacgtggttaatcacgagatttatcaaagcatcatcaagagccatgcgcggatgacttataacaacgtcaacaagattgtgaccgaccatgacccagaagtaatggccgagtatcaggaacttgtgccgatgtttgaagacatggttcaactgcatcaaattctttacaagatgcggcatgctcgaggtgccattgacttcgaagaaaacgaagccaagatcattgttgatgatatgggtcacccaacagacattgttctgcgtgagcgtggtgtgtcagaacgaatgattgaatccttcatgctggccgctaacgaaaccgtcgctgaacattacaacaagcaacatttaccattcttataccgggttcacgaaacaccagatgccgaccgtattaaagaattcatggaattcattgctagttttggtatcaccgtgccgatgaaaaaaggcaaagaaatcaccccaaagcaacttcaggatgttgtgacagatgtcaccggcacgcctgaagaagcaatggtgagcgttaaaatgctgcggagtttaaaacaggctcggtattcaccagatccacttggacattttggcttggcagcaaagtattactgccactttaccagtccaattcggcgttatcctgacttggtcgctcatcgcttgattcgtgattatgcggttgaaggcactggcgacgatatcaaggcaagttggaataagaaattaccagatattgcagctcaggcatccatggcggaacggcggagcattgacgctgagcgtgcagttgacgatcttaagaaagctgaatttatggctgataaggtcggcgaagaatttgatgctgttgttagcggcgtgacgagctttgggatgtttgtggctttgccgaacaccgtagaagggcttgttcatatcacgcggatgaccgatgattattattcattcatcgatagtcagatggctttagttggcgaacgcaccaagcgcacgtaccgaattggccagtctttgcgagttaaacttgataatgttgatattgatcagcgacaggtagatttttcattgattcctgatgaaaatacgccaacaagtgatctgggcaagttcgtcaaaaaagaagaccggcgtgaacgtcggccaaatggcaacaagcctggttttggcaataataaccatggtgggccaaatcgtaatcaacacaacaatcgaccacgcaaaccagctggtgcgccacatcaaggcaagcactataatgccaagcgcggcactaaataacgctggcaacttttgaaagggggatggttcaatggcgaagaaacatcgacaaaaacctgacaacctgctcgcccagaataaaaaggctggtcatgattacaacattcttgatacctacgaagccggtattgcgctgacaggtaccgaaatcaaatccgtgcgtgatggcaaacttaatttacgtgacggttttgcccgaattcggaataatgaggcgtggttagaaaacgtccacattagtccgtataaagagggcaatttattcaacgttgacccaatgcgtaatcgcaagctgctcttgcacaaacgagaaattcgcaagttaggtcaaatgacagcgcgccaaggtgtcacgcttgtgccgttgcggatgtatctaaaacacggctatgccaaggttctgattggtgtggctgaaggaaagcataactacgacaaacgtgaaaccttaaagcgcaaggatcaggaacgcgaggttcagcgcgctttgaaggcacggtattaaacgcgcagtggcattaagctaatgctgatctgagcatcaaaaatcgatcttctagcttgtccatcagcaatatcatgatgtcgctgatgtgcaggttaggtgacgttatgccaactgagttttatcagtaaagagcaccgggagaaacctggtgctctttttgttttgctatcatttatttctaaacaagctaaagtgttgatgttatataaataattacactattgattgattaataatttctttttcattgttttgcttatttatttatataaaatggtgatttttccttctaaggttttacttaagtaagaactaatataaaatagggcaaggagactgtcgttggtcaatgcctttgtcgacgaacttcagttgaggagggaggatagcatttgtggtcacactgtctgatgtcgcgaaagaagccaatgtttcaaaaatgaccgtgtcccgtgtcatcaatcatcctgagcaagtgacgcctgagttaaaacaactcgtcgaacaagcaatgacgattttgcattatcgacctaactctgcagcgaaggctttggccaataatcggactaacgttatcaagtttttgattcttgaagatgtggatacgaccgaaccttattacatgacgttgctattcggcattgcccgaggacttgatcgtcagcagtatgctttgcaattagtgacagatcgcgagcatcttgatttggatcacgccgatgggtacattattacgggtgcgcggtcgactgattgtcaatggattgatcagttagcgaaaccggttgttttatttggggaaaatcgtcatggttatgattttattgatacggacaataaattaggcgaacaacaagcaaccgaatatgcgctggccaagaattatcaatcgattatttttcttggtattgatgtgagagaaccgtttgaatattcgcgtgaagcagggtatatcaatactttgcagagacatcaaaaagtaccgcagattcatcgaatgggtaatcatagtcacgaatcgcaacattttatcagtgaaaattggcgaaagttcgcgcgaaatactgttttcatctgtgcaagtgatcgcctcgcgttaggagcggtcagagcgattcaacaaaatggtgggcaaattccaaccgactttggcgtcatcggatttgatggcgtttttctggatcaagtctcaaatccaaaattaaccaccgtgaaacaaccggtggtgcaacttggtgaactattagcacggatgctcttgcaaaaaatcgcccagtcaggtgcacaacaaggtgaactactggtgccgccaaagttagtgcttcgcgggacgatacgcacttaggtgattatagaattccgatctggcaaaatgagtttgtctactgataggtcggggtaacattcacagttatcaaacaggccaacaattttccgctgggaaattgttggcttttcttcacttcattttgataacggtaacaaacgcagttaacttgtatcatgcgtgcgctttcactatgctagttggaaaaggggggcgggtcacatgaacacttggtatgatcaggcgattatttatcaaatttatccgaagtcatttcaggacagtgatggcgatggtattggggatcttaacggcattcggcaacgcataccgtatctgcaggacttaggcatcaacgccgtttggctgaatcctgtgtttgtatcaccgcaagtcgataatgggtatgatgtcgccaactattacgcgattgatgagcgaatgggaacgatggccgatatgcaggctttgattcatgaacttcatgaagcgggtatccgtatcatcttggattttgttttgaaccacacatcggatcagcacccgtggtttcaagatgcaagccggaatgtaaaaagtatttatcgtgattattatattttttctggacatcatcataaaagaccaaataattggggaagcttcttcggcggctcggtttggtcgcctgatccagccggtaccggtcaatcctatttccatttatttgatcagcacatgccggatttgaattgggccaatgccgaggttcggcgtgcaatgggggatgttgctgaattttggctaaacaagggaattgatgggtttgcggcttgacgcgtttattcatattgccaaagttgatctggcgcaaaactatccaacgtcggaaagccaacaagagcctgtgattgcagaaccgttttttgctaatctgcccaatgttcagcggtggttgcggcccttctgtgctcagatcaaggcagattttccaaatacctttatacttggggaagcggcaagtgcaaatgtcaatcttgctgttgactacacgagccagcataacaaattgatggatagtgtgattactttccgatattttaccgaaaatacaacgcaacttgacaccagcatcccagcgcagtatcagccgaaacctttggattttgcaaagtttaaacagacacaggttgtttggcagcaaacacttgctggtgtgtcgttgccgacgctttattggggcaatcatgatatggctcgtctggctacgcgcattgcccattcagcgattcaggcgagaagtctggcagtgctgatgtatttacaacgcggtattccaatcatctattacggtgaagagctagggcttgaaaatctcacgttgcctgatgcgaaagctttttccgatccaagcgtcccgcgtttcattgcagcagctgtggatgcagggtatacccaggaggcggcgttagcgatggtcaatgcgacccataagttgccagcgagagggccgatgacgtgggatgcgacaaccaatagtggctttacgagcggcacgccttggttggttggcaagcgcagcagccgcacgcatgttgccgaacaacaacatgatccgcacagcagccttgcattttacaagcaattgattgctttaaagaaacggtcagtctttcaaacaggcagttttcgactgttgagcacggggccagacagctatgtgtattttcgccagacagacaaggcgattgccgttgtggcagttgctttgagtgataaaacagtcaaccttagattgccagccggtgactatcaagcggtgctaatcgtcggtgacgcgacactgagcgaagaaacactgacactatcagccgattcagcagcagtattcattcaggaaaaggagcgtgctaagccatgaatttagcagctatgtctcatcgaccagaaagtgaagattgtttcttatataccaataaaaagctacgtttgcggttccatacggcacaaaacgatgtcgccaaggtggttgttttgtatggtgatccttactggcaagagcttgatcagcatcaacaatatcggttgagttatcagcgcaaaccgatgagtcagctagggacaggtcaagttgctgatcattggggagtgaccttggaggcgccttatcaacgtctgcagtacctgtttgaagtgaccggacaggacggtagcaaatggttatttggtgatcggggattgcgaaaagacacagagtccgcgcgaattgataccggcaattattttcgtgtgccgtattttcacgagattgatcgggtgaaaacgcctgattgggtgaaagaaaccgtttggtaccaaattttcccggaaagatttgccaacggtgatagcacaaatgatcctgttggcacgaaaccttggcgaccgtctgatcatcctggacgtgatgattactatggtggtgatttacagggggtcttggatcacttagatgatttgcaagcattgggtgtcaatggtctgtacttttgtcctatctttaccgcgagttcaaaccataaatatgacaccattgattatttaacgattgatccggatttcggtgataagacactgtttgccaagttggttaatgaagcccataaacgcgggatgcgcgtcatgctggatgccgtgtttaaccacatgggctttgctagcatgcagtggcaggatgtcttagcaaatggcaaaaaatcacgctttgcttcgtggttccacattcatgattatccattgacgccatttcataatcccctgaaaggcgagggagcgccacaatacgatacatttgcgtttgagtcgcgaatgccaaagttagatacggccaatccagcggttcaggattatctactgcaagtggcaacttactggattcaagcatttgatattgatgcctggcgtttagatgtggcgaacgaagttgatcatcatttttggaaaagattttacagcgctgtcaccgccattaaaccggatttttatattttgggcgaggtttggcatagcagtcaaccttggttaaatggcgatgaattttccggtgttatgaattatgccttcacgcagcaaatagaggaccactttttgaccggtaagcagacagctgcggggatgaccgctttgttaacggaccaattgatgctttaccgcgatcagacgaatcaagtgatgttaaatatgttagattcgcacgatacacctcggttgttaacggtagcaggtgatgacattgagctagcgttgcaagcattgacctttgcttttcttcagacaggtacgccatgtctttattatggaactgagatgggcatggatggggaaaatgatcctgatgatcgaaaaccaatggattggacaaaattaggtcagccaatttggcaacgggtggcgaagctcatcggctttcggcgtgaacatgcggctacccttgggcgtggtacgaccaaattagaagtgacaccttctggattaattaaggttgtgcgccacggccgtgaaacgctgacggcatatttcaataccacagcgtcatcggttcctttgacggcggcacctgttttgcatcaagggtttgctcaaaatgagttagctccaaaaggatttgttgtagcagtaaactaattatgatagcggtaacattcattttgcgattgtacagcgctttcattcatttataataaagcgtgtcctttaagtggttgttgccatgactatcgtaaagaaaatggtcacaggggagaagtggagaagatgaaaagaacatttgcagtcgatccgtggatgattgcaacccatcagtttcatccagaggacaagcggcttcaagaaagtttgacggcaattggtaacggctacatgggcatgcgcgggaattttgaggaacagtactcgggggatcagctttcgggaacttatctcggtggtgtttggtttccggataaaacccgcgttggttggtggaaaaatggctatcctgcgtactttggcaaagcaatcaatgcacccagctttttgccaattcgcatcaaagtgaatgaacaaccggttgatttggccaaaaacagttttcgggatttctatttggcacttgatttacatcagggattgttaactcggcagtttatctatgaaggggatcaggttgaggttcggtttgagtttcaacgatttttgagcaatgtggtgaaggaagcagccttgattaacgtgaaagcaactgtgcttagcggtaaggcaacgatcacatttgatgctggacttgaaggtcgtgtcgctaatgaagatagcaactatgatgagcggttttgggaaccgcaagctgaggatcccactcaaaaaaccattcaattgcaaaccaagccaaatccttacgatgtaccgcaattcaccgttctattgaagcaacagttgcgtgtcaatcgtcaaccggtcacaggcgttgtcacgactggcaacggctggctaaacgaacaaattgtggttgatgtggcagctggcgaaacttatcaactggaaaaggatgtcattgtggttactagccgcgatgttgcgccttctgatcagcagcaaacagccgcagctttgatgaccacattgcaaacacacagtttttccgaacaactggctgctcatacgcagctttgggcgcaacgctgggagcaaagtgatgtggtcattgaaggcgatccggccgcacaacaaggcattcggtttaatattgcgcaattgtttatgacgtactatggcgaagataagcgccttaacattgggcctaaaggttttacaggtgaaaaatacggcggtgccacttactgggatactgaagcttatattgtaccaatgtatctggcagtgacgcccccagatgtgacgcgagcacttcttcaatatcgccacgatcaattacctggtgcgtatcataatgcacagcagcaaggactggccggtgctttgtttccaatggtgacctttaatggcatcgagtgtcacaacgagtgggagatcacatttgaagaaatccatcgtaatggtgcagttgcgttcgcgatttatcaatacacggcttataccggcgatgaaagttatgtcaaccgtgatggtattgaggtcttggtggggattgcccgtttctgggctgaccgggtgcattttagcaaacgtaccaatcagtatatgattcacggggtaaccggtcctaatgaatatgaaaacaatgttaacaacaactggtataccaacaccatggcatcgtggacgttaagttacacgttagcgcgcctgcccaaggcgaatgccgacgtggtcgctaaacttgcggtgactgcagaagaaaaagctaagtggcaagatattattgatcggatgtactatcccgttgacgatgaattagggatctttgttcaacacgatacctttcttgataaagatttgcgacccgccagttcgattcctgctgaccagcggccaattaaccaacattggtcatgggaccggatcttaaggtcgccttttatcaaacaggctgacgtcttgcagggcatttattttctcaatgaccgcttcacccaagcacaaaaagaacgcaattttgatttctatgagccgatgacggttcacgagagttcattaagtgcgtccatccatgccatcctagcagctgaattagggaaaacggaaaaggccgtggcgttatatgcgcgaactgcgcgtctagatctggacaattataataacgacactgatgacgggcttcacattacgtccatgagcggcagttggttatcaatcgtccaaggctttgcggggatgcgctatgatcacgaccggttacgattcaagccatttttgccaaaagaatggcaccgcttcagctttaaaatcaattatcgtggccgtttgctggcagtggacgtgagtgaggaggtcaacgtgatcttgttagccggcccgtcaattgatattgaagtgaatggtgagctgcagcacttggaaaagggggatgaccatgcttaaaggcttcatttttgatcttgacggggtggtcaccgattcagctaagtatcatttagccgcctggggggagttggcaaaacaattagggattaccctgccagctacgtcaaatgaggctttacgtggccgttcccgaatggactcgttagcgatcatcctcggttacggtgatcaacagaagcaatataccgaagttgagaaagaaaacttagcagatgaaaaaaatcgacgttatcttcaattgattgccaatatgacgccagccgatattctgccgggtatcagtcaacttttatcggacgccaaggcaaggcatttaaaattggcaatcgcatctgcttcaaaaaatgcaccgactattttgcgtcaattgaaattatttaatcaatttgatgcgattgttgatccagctagtctgcatcgcgggaagccagatcctgaaattttcatcaaagcgcagaacttgttgcaattgcaagcagatgaagtggtgagttttgaagatgcatctgctggtattgcagcaattaatgctgctggtcagttttcggtgggtatcggcgatgccaaggcgctcgcagctgctgattatttcgtggcaaacacagacttattgcgactcaaatcaatcacgacagccttcacaaaatggcaaaacgcgttgaataagaaaggagatggatgatgtcatggttgagattgatttgaaccatctttataagaagtacccgaatgccgcaaaagattctgtcaaagatttcgatctgcacattaagaataaggagttcattgtctttgtcgggccgtctggctgcggctgatattcttggcctgacagagtttttggcccataaaccagcagacttgtctgacagccagcggcaacgggtggcattagggcgagctatggtcagagatgcaccgatttttctaattgatgagcgctttccaatctggcgtacaattgctccggctcggcactatgatctttaagtgctatcaggctaagtataagaaatgaaagagaaatggttttcaagttttgttaaaaatcatttctctttattttgtaaatataaatgcctctgaaatctttttttgtgtcttgaaaagtcaaaatgttttgacatttaaagagttggtattatactgaagatgtcaaaagggtttgacatcaaagggagtgattatcatgaagaaaatggatgagatggagcttaaattcagagatcaatcgattagatactcttgggctttcatgattttcacattattcatttacgaatttttccacgtgatgcattatggaaaatttgattttatttctgttgtggtaaacgttgcagtgggtgtccagattgctagttttttgtggcttaaacatcgagcagataagactgataaagaaccgggaagggtgttaattggcacgattgtcattgttgttgttgtgctaaccttaggcatgattggattgatgttccatggaaaataatatccacgcactcagaatgcgccaaaaattaacccaacaggaactggctgatgctgtaaatgtaactcggcaaacgattaatgccatcgagaataataaatacgacccaacactctccttagccttcgcacttgcagaacgcttggagacgactgtggatcaactgtttcaacattagagaagctgaaaattatttaaggctacaaaaagaagagtgactttttccgatcaccgcatgtatgcggcggaaaagtcactcttctttcgttttactgtagatcaaaggtcatagtttaaagattccagtgccaaggcggagcaatcggaggccagatggggctcagccgtgcaaacaacacagcgaagggcttttgagctgatgttgttaggcgacttcgagaccggtctttgggctcgaagcgccgtcaccgcgttccagccccatctggccggagattgcggagtttggcacggcaggagtcgtttttgtctgacgcttgtgccaaatcatcccgcatctaacaaatcataagttctagatagaaactgaagaagcaactactgctgacgattactcctcttcatttaattcatcaaaatcatagtacaaatctctttcaggaagcaccacagcggcatttgtctgggtatccaaggcttcggcttcgcgttccggatggaagctatgccatggcacaatggttcgaggattgacttctttcgccaaagtaattaaatcctcacggctagcatgacccgaggcattcatgaactgcaaggggatgtgatgcgcttctagccagtctttgagttgcgcaaaccgcgggtcgtaatcgcctagtggctcgccgttactgtggatgtaggtcgtgatgggcatgtcagtcagtcgttccagatggtcaaaactattttgcaggacatagtgttggggatcacgggcaatgtccgtcagactgattgcttgaccaagaatagcatcgggtttttgatcggtcatggtggtcagcacagccgcgtcatcaggttcccacaccaattgacgtccggcagtgtgtgcactggcctgaaaactcgacagacgctcgtaattgcggatgtaaggattgatgacgacaagcgtcgggctttccgccagcactgtctgaaattgcttctgcaggctcatttcggtcaatgggatgctggggtgatcctgatcttcgactggtgcagctgtatcaaaagagaagctggtgccttccaacataaacaagcttagcttttcttggttaaatcgcttggcccaggcatgaacccgttcagcatgcgggccatttagccggacatcgccagaatgggcgtagcggcgtgagccgtcatcgactaggagcgccatgacgcccggctcgtcgtgatcactgtggaagcctgttacggtgaggtcaccgatggttaagggctgttcataggcaagcggatgcagatttgcaactggcttttcgatgcctagtttgattaacagttgatagagcttataggatggttccgaaagataaatcggaatcggtttctttaaatattgcaatgcacccatgtggtcaatgtgcagatgtgagataaagatggcctcatgtgtgtaaacgtctggttgatcaaaaaatagttccggcacatgcggcaatttaccattatcgatggcagagctgactgtttcgttgctgagatcagcagccacgccgaagtccatgataacgcggctggttttagttgcgaattcgacgatgttgccgccgatggtgtttaacccatttaaaaagcgaattgttgtcacagtgttacctccaattgtttcaatatcattttgagaacactaaagcgtaccccgccggctaccgaaaagcaaacaaaaaccgaatcagcacatagctgattcggcaaagatcaaggcggagcaaacaattacttgtttgtcttgatgatggtttcagtttgaccctgaagtgtcttcaaagcctgatctggtttttcatgcttagtcagcatcgcatcaaccgcattaagaagatcgttacgatattctgagaagccgatgaaagcggtggactggaagccaaagcccaaagaatcaactgcagcttggctagttgggttagcactcagatatttcttaaagtcagcagatttaacagcggacttacgcagtggcacataaccagtcaattgggcccacttggaagtttccttctcagaaagcaggtacttcatgaatgcccaagcgcctttttgcttatcgctagatgcggacttgaagaggacgatatcattaccggcaagttcggttgcctttttgcctttgtagcttggtagcggcattgtgccccacttgaagtctttcggtgcattttgcttcatgttggtgatcccagcacttgaaccagcataaaagagtgttttaccagcagtgaagttcttatcgccgtaaatgtcttcgccggcagtcttggcttcgccgctgttaaccatgtccataatgaagttagcagcagttaaggttttcttgctatccaagttagctttcagcggatcagctgaaactaacggattgccagcctgacgtgccagaccttcaaattccatatcaaaactcttatcgaaaccaatagcggcaataccgtctgccttcagcttatcggcatcttttttgatgtcttcccagctggttggcttggcaatattgtatttcttcatcagtgcttcattgtagaaaagaatacgtgtggacttggagaatggcacgctgtaatacttaccttgatacttggagctggacaagaaggctgggtagatatccttcaagtcgctgctgctcatcttgtcgtcgcctttgagcatgtattgatcaagcggggaaataaaaccatttttcacgtagtcaggaacagtggtataagttgtttgggcaatggttggcaggttgcgagattttgctgcagccatgatcttttgttgcaaggcggtgtagttaccttgcgcggtgccgacaactttatactgtttctgactcttattgaaatcattgatgatttgatcaagagctttttggtaaggaccgttcatgccgtgccaaaaagtgatcgtcacccgtttgcccgaatcactcttggtacttgaactcgatttgctgctgctgttactgccgcaagccgtcaaaacagcgacaagaacgacagtgaacattgcaagtaatgcttttacccaagtttgctttttcattttggtagattatcctttcaatccagctttagaaatcccagcaataatgtacttctgcaagaagatatacaaaacaaccattggaatgatgacgaatgtggaagcggccatcagaagttgatattgcgtgccggcatcggtcgtgaaggcctgcaagccgactggcaaggtacgcatcttgtcagagttcgtaacgatcaatggccacatgaaggcattccatgagccaatcacctgaagaacggtgaccgcggtaatcgttgacttgctcattgggacaagcacttgccacaaatatttccaatcggacgcaccatcgattttagcagcgtagtagatctgattcggtgttgattggaaagtctgacgcaaggtaaaaacggtgaagaagctggccaaccacggcagaatcaaagcgccgtaatggtcaatttgccctaagtgtgacaaggtcacgaagttagggatgatcaacatttcacctggaatcatcatggttccgaggaaaataatgaacaagaggttcttgccgtaaaacttcaatcgagcgaaagcaaaagcggcaagaatactggtaaagagctgcccgaccgttgtgataacagtgacgatcgtgctattaatgaaatactgtccaaacggtgcttcgttccacgccttgacgtagttaccccattgtagaaccttagggatccagatcggtggaacggcaatcgtttccggtgccgttttaagtgatgtggagatcatccataagaaggggatcagcatggtgatcgcgcctaaaatgacaatcaggtaaagcagaattttactgatttttttagccatgtttttgcctcctccttagtaatgaacgtgcttgcgggaataccacaactgcacgagtgtcactagcaggatgaggaagaaaagcacgaccccagacgcagcagcaattggatacttgtactcggtataaaatttctggtacagatagtaaacaattgtcaaatcagctttacctggtccgggcgtgccttgaaacaaggcgaagatttcatcgaacaccttgaagctgccgatgatcccgttaactgaaaccaagaaagtgattggtgatagcatcgggatcgtgatgttccaaaatcgctgacgcgcgttggcgccatcgatttcagcggcttcgtaatacccgtggtcaatgttgttgagaccgaccaagaaaagaatgatgttgaagcccagacttttccaaatactcataatgatcagcgccagcagtgcataatgcggatcagtcagccagttaatgggatggataccaaaccagcccataaagtagttgatcagcccatagttactgtggaacatccaattccaaaccatcgcaatcgccacagtactggtgacaaacggcaggaaatagacggttctgaagaaaccggagatgatcttcacctggtttagcaataaggcaatgatcaaggataaaatgacagtgatcggaaccacgccgacaacaaaaaccagcgtattccgcacagccaagtgaaaatcaggatcattccaaagataaacaaagttatcaaagccccaagcactgaccttatcagtataaaaatcatacttcgtgtacaaactcatcagaaatgagttaataatcggccagatattgaaggtgatggtaatcaccagcattggcagcaaatacagcgctgctttggcggtcgattttaggcttgctttttcattcagcatgactttcaccaccaaaaatcaaggcgccggattggtcaaaaagaaagaaacccgacttggtgagatagaaatccagatctggttgattagctgcgacaccagccatttctgttgacaacaggtgctcgccgttataagtaatatcggctgtagcttcccgcccatatttagaactttgcgtgatcttgccgtgaagcttggctaggacattgtcgccggcatcataagggatgatggcttcactacggatccccgcagtgactgcctgcttcaaaatatcttccgacacggcgctagctagatcagttgtcaacgcttgtgctggcaaggtgttgatcacaggctcaccgataaacttagcaacgaacaaattgttcggtcgctcgtatagtttttggggggaactgaactgttgtatcgaaccatttgccaaaaccatgatgttatcagaaatgtgcaatgcttcatcttggtcatgggtcacgaaaatcgtggtaacaccggtttcgcgttgaattcggcgaatttcttcgcgcatctcaattcgaagccgggcgtcaaggtttgacaacggttcatctagcaacaataggctaggggacttggctaaggcacgtgcgatagcgacacgctgttgctggccgccagaaagtgcccctggtttcttatcaagctgatcctcaacatgaaccagtttggcaagatccttggctttggcgtgccgttcagccttgctgaccttggccattttcagtggaaaggcgatattgtccaacactgacaaatgcggatacagactgtagttctgaaataccatcccaactttacgcgctaaggcatcttttttagtcacatctgtatcaccaaaaaagatttgcccagcggttggggacaacaacccggaaatgagattcagggtcgtggttttaccgccgccggaaggacccagcagggaaaccagcgtgccatcgggaatggtaaagttcagatccttcagggtatctgtcttgccatcgtaggacatcgtgacgtccttgaaagtaactttcaacccagtacgctccttcaaatagttttctgctcctcacctccgttcgtcggtctccagcaacaaaggctgtaagaacgcgcaaagagaaaatttggaacaagatattgtggttgcttcaccatgattagctacatctagagaaggcaaacacaactcttctcacattttaacccagattcactgaaaaatggactcattcgcccaaaaacattttgattatgtttaattgccatcacaacgcgaatgttcgccttttttgctataatagaaagcatgcaaaaggcgcaacttgaaccaactgctttcgctgctgatgagtgtcagcaaattggcggttcattcagcgccaataaaagaggagcgatttttttgataatacgtccaagcaaaccggacgatgcgccgcaagtagcaccgttgatcgatattgtgtttacggagatggaaattcctcagttaatgaaggttcctaagaagaccctgtattcggttttggaacaagcctttttactgccaacttaccggtacggttacccgcaaatgttggtggctgatcaggacggtcagattgaagggattgctgttggctatttgcatgagcaggaagcccatatcgacgatgctttaaaaccgttgttgcctaagctgggattgactccaaattcatcgcttttttcagacaccgaaacttatgccggcgagtggtatttagatacgctagcagtcgccgagacagcgcagggacatgggatcggaaccaaattattaaacgcagtcgatacggttgctcgggctcggcacgctaaagtggttagtctgaacgtggatcagcagaatccgcgggctaaaaagttatatgagcgcaatggttttcttaaacacggcgagttgatgattggcagtcatcgatacgatcatatgctgcggccggttgtgggcgaggaagtttaatgttagtcaataggttagcctaaagcccttagcccgccgaacgccgcaatctccgaccagatggggtttgcgacgcacagccagagtggagacggcacttcgagtccaaaaaccggtctcgaagttgcctaatcacatcggctccaaggtcaggttgtacggctgaacgccatctggtctacgattgctccgccttggcactaggatctctaaatagcaatgagaaataaagacgactggtattccatggaggaaaatcagtcgtctttatttcatagctaggaatgatggtcttagcttttcttttcgtttaatctgggaaatccagcccatattcataacgcttcaatggatcggccacacccacatggcgaaagcggtcgaggattgcagctaacaaaatggccgctggaatgtcgcggttattgggaatggtcaacttaacgattgctggtgcaatttcttcagcactgaagatcgttttgaccccatgaaacacttgataatggttattcaaaagattacccatggcgacccagttgagatctgagataaagatgaactgatgccagaccccaaacatttttttgacgctggcaaccttgcgattggcgatataaagatcatagcgcgggaaaacgctgaccgttttttgccgaatggatccaagcggttcgccgcttaatgtatttaaatcgaagccaccattaatcagtccgtgccgacccgttagaatgtaggccggcttgccgttatcggttttgaccacacttaaactactcgtgcttaaagcattgatatcaagatataacgccatcggccaacctcccttatggtgagcgtgaactggcgcggttagaaaccggagcataagcgggctcaagtgcgatgggcgggttttgcccattgtgcttgaggtccttatgagcaggtttctgcgtcagtgagcgcgttatggtgagcgtgaaccggcgcggcgcctgtgtttaaaaaattaaaatcagcaaactatcgctgcgccaatgattattagaattgagcgtttgatttttccgccttattaatgcgaatggctttgcgaattgcctgagcaacgccgttttcgctattagtggcagtactgccccatgcgagcttggtgatttcggggatggcgttccccatcgccatgccatatttggccattttgatcatgctggcgtcattcaagttatcgccgattgtcatgacctcatccatggtaataccgcgttgcttagcgaaagcttcaacagcataacctttttgcgctttgatgttgttgacctcaatgttattcgcagagcttgaggtgacacttaatttaccggtggcttcaaaaaccttcgctggtgctttcaaaatatcgcgttgctcgccagtaaacgcaatgattttcatcacctggatagtagggtcggctagcagttctttatagtcactaacgtaattgatgttcatgatttccagccgtgcagctgcgagcgcaaccgccagtttgtaggttgtatctgggttgagatcaaccaatagatcggcaacattttgaatacgtttgacacggctgtccgagaagacgcctttgttggtgatgatttcaaaatagatgtcgtccttttgcaaggtctcgacaatgaaatcgcttaggtcactagcaattggaatcgtgaccaccaattcgccagcttcatcaaaaaccatggcgccgttgagtgtaatgaatgctggtttgagatcttgggcggcaagtaacggtgtagcttcggtgacgccgcggccagttgcgaccataaattcgataccagcggcttgcgcgtcacgaatggcttgggcgttttcgtccgaaacttccattttgtcgtttaaaagtgtgccatccatgtctgatgcgataagtttgatcatatttactgttccctccggtttgtcatggtgcggttacgcctccaattctagcatgaaaaagcgtttcccggtagcaaacccgcggtgattcttgtacactatttgcggaggtgcacgtcttgaaaacattaatacataatgactggcagacggtgctggaaccggtatttgaaagtcctgagtatgctcaactgcatgcgttcttaaaagaagaatacgcgacaaaaacgatttaccctgaaatgcaccatatttttcaggcattcgaatggacacctttccatgatgtgaaggtggtcattctaggccaggacccttaccacaatccgcggcaggcggttggtgcgagctttgcggtggcacccggtgtcgctttgccgccgtctttgcaaaacatttataaagagttgcaaagcgatttaggctatccaccggtccatcatggttatttgaaggcatgggcggaccaaggcgttctattgttgaatgccgttttgacggtacaagccggcgaagcctattcccatcagaatcatggctgggaagagttgacagatgctgccattgctgccttgtctgcacgcggcggcgttgtgttcatcctgtgggggaacgcggccaaaaaaaaggcggccgtgattgatacgagcaaaaacgcgattattgcatcagcgcacccaagcccgttatctgcatctcgtggcttctttggcagtcgcccgttttcgcgcaccaatgcggcactagaaaaaatgggcgagaccccgattaattggcagttaccagaaacggtgaaggcggattaacctgaattgactagccttaagtggctcagacacactgtttttccattgtcttcgactagtcacgacccgataaaaacggtatgatgaacaagaataaagcgcttttatggagggataagatttggacctatttgaaagtttaaaagacaagattaatggcaaaaatttacggattgtatttccggagggcgaagatccgcgcgttttgggcgcagcagttcggctcgcagctgacgggttgatacaggccatcgtgctaggtaaccctgataagattcagacattggcagctgctaaaagctgggatctcagcaagttgacagttcgcgatccagccaacgatgacattcacgcgaaaatggttgcgtcctttgttgagcgtcgcaaaggcaaggcaaccccagaacaggccgaaaaaattgttcaggatgccaattattttggtacgatgctggtttacatgaaggaagcagacggtatggtttcaggcgcagttcattcaacggctgacacagtccggcctgctttgcaaattatcaagacgcgtcctggcgtgcatttggtcagtggtgcgttcattatgcagcgtggccgtgacgaacgctacttattcgcggataacgccatcaacattgatccagatgctgatcagctggctgaaattgcggttgagtcagctaaaaccgctgccttgtttgatatcgaaccaccgcgcgtcgccttgctgtcattctcaaccaaaggcagtgccaagggaccgcaagtagataaggtagttgaagccactaagaaagctcatgagctggcacctgatttggccttagatggtgagttacaatttgatgctgcttttgtcccaagcgttgccaagcaaaaagcccctgattccaaagtggctggggaagcgaatgttttcattttccctgaattacaatccggtaatattggttataagattgcgcaacgattcggcgggtttgaagccattggcccaattttgcaaggtttgaatcagccagtttctgatttgagtcgtggggcaaatgaagaggatgtctataagttggccattattacagcggcccagaccttgctatgacaagtttgaaaaaagacttcactagtgaggcagcactgcaatcctttgcggcttcactgggaccgcagttgcaagcgggagacgttttgctgctggatggtgacttgggtgctggtaaaactagtttcaccaagggcttggcaaaaggcttaggcatcaccgattacgtcaaaagtccaacatttacaattgttcgcgagtatcgtcatggccgattaccgctgtatcatatggatctgtatcgcttagaagacggtggggctgaggatctcggtcttgaagagtacttcgaaggtgatggggtgtctgtcgtggagtggccggattttttgggattaagtgaaccagagacctatctgatgattcattttcaaaaagatgacaatgaagatacaacgcggcatctcgaatttgtgccgtttggccaacactatgagaatttactcgaaagcctatgatagcaagcacgcaaagaacatttgcgtgcttttttgatttggtttggtaaagtggagcagaacaaagaaaaggcggtgcgttatgaaatttggcgaacagttggccgctttgtttgttgggcttttcgttggcgaagtcacaatctgggcagttatccacacttttcgaagacaatggcgtgcatgagggtcacagaatttggtctggctgctttcactaggacaataaatctacttttgataacacgttatactttgataaccaaagtatgcatggtagactattgacaacgtgagaaagtgagctaattcataacgtgaacaggcacgttggcaagctgagatattggtcttaggcgtgatgaccagttgtttgtcattgcttctgaggctcttaccatcgaggcttgagcatctgtgagcgcgttttaagtaaaggagtagtggccatgctagaagtcaaggatcttgtgaagaccttcggcacgatgacggcggttgatcaggagagcttcaccgttaaaccaggtgaaatcatggggttgatcggccaaaacggggcggggaagacgacaacatttcggatgattttgaattttttgacaccagactctggtgccatcacttggaatggtcatccgttaacagctaaagattatgacaccattggatatttaccagaagagcgcggtttatatccaaagatgcgggttcaagatcaaattatttattttgcgcgcttgcgtggtatgcgcacgtcagaaattaaagccaagattccagaatggatggaccgatttcaggttaaaggcaagcctaccgataaaatcaaagacttaagtaaggggaatcagcaaaaagttcaggtcattgccacaatgattcatatgccaaagctggttattctagatgagcctttttcgggacttgatccggttaactcaagcctgttgatggctggcattcagatgctgaaagataatggcgctgcgattatctattccagccatgatatggctaacgttgaggctgtttccgatcatctggtgatgctgaaacagggacggatggtcttaaacggagcggttggtgagattcgcgaaagttttggtcggaccaaactattcattgagtcagggttgactgccgatgacttgcgtgaatttgacggggtaacgaaaatcaagcagcatggtcaagaatttgagttgaccttagccgatccggcagttggtcaccagatttttgctaaagcaacggaaaatggctacataccagagttccgtcaacaaccaccgacacttgatgaaatcttccgtttgaaagcaggtgaagctgatgcataagttttgggtggttatgagtcaggtctataagaaaaatgccagaagtggttcatggatttttctagtattgtcaccgctatttttccttgcgattgcttttgggatcgttttttatatttccaaaacgcaagcacctgctcaagtcgcagttgtcagtgacgttagcgttgtgcgccaagcattgagtaaacaaagtaccagtgatttacgctttaagccgtatacttctgctaaaaaagccaatgatgcactgaacaaagaagatcttgatggcattttaacggtgaatgccaaagatgacttcaagtcgcattatgttgctcgcgataacggtcagacagttgagacttcaacgcttgtggcagcgctgagcggattgaaattaagcagcacggccgcagccatgaagctgacaccagctcaggttaaggctttaacggcaccgccgacagtgacatcgaagacggttgccattgaggatggcaagcaggtagccaaatccaatacggcacaacttatgaatcatggccttgcgctcgtttcaatggttttgattctgatggtcaccatggtgtatggttctattctggcacaggaaattgcaactgaaaaaggctcgcgaatcatggagatccttttgtcctctgtcagtgccacgacgcaattctttggcaagttggcgggtattttcgccttgttgctgacacaactggttgtttacgtgattgccggtgttatcggctggcaatttttgaaaaatcaaacaatggttgccggcttgttaaagcaagtggatctgtcgatactagcttctgggacaaccgccatgattgcgcttttctttatcatcggcacactcacttattcggtcttggctgcattaaccggctcgcttgtttctaatcaggaacaagtccagcaagctgttatgccaattaccatgctggggatgatcggctacttcattacaatcgccgcccaagccaatgattcgacgctggcacaagtaacaagctacgtgcctttcttgaatgtttttgttatgccaacgcagatgtcgctaggccgagcaagtatgggtcaggcatgggtcagtgtcggtattagtgtcgtctttctcgccttgtttactttctttacggtcgcggtttatcggaataacgtcttggtctattccggttcgggcttgtggcaatcaatgaagacctcctttagcatttggaaggcggaacgcggtgtggctaaaaaataaatataattaggcaaaataggcaaaataaaaaggcgattcctcagcgaagtcgcctttttgcatggcaatgtattcagcagttaatgagcgcgcagtcgggtcaaacgttgagcggttgccagtcgtacctgaatcaacccgcttttgaaagcttcatcatgcttttaatccgcgcttcgccaaagtgctcattttcggcgatcaaaatccgtgcacaggcataactatccgctaaggcattgtggtgatgctcaagcggaatgtgtaaggcggcactgacagtatctaaccgatgattcggcaacttcggcaaaaagtgtcgcgaggttttaaccgtgtcaatcacttgatagcgcggcgccgcaatgccgtaacgatccagtgtcagtcgcataaccgaaacatcaaacggtgcattgtgagcggtcacgatccgacctggcgtatagaacatttgaatatgcggccaaacttgatcaaatgttggctgatcttgaaccatttcaggggtgatgccatgaatgtgaatgttttgggcatcaaactgcatctgcggattaataagggtgtaaaaactgtcaaccaccttattttgctggacgaccacgagcgccaatgaacacgctgaggctcgcttgcgattggcggtttcgaaatccatggcgataaagtccatcgtattttctcctaaatcaagtcttttgtgacaagttcaactggacagtggtcactgcccataatgtcggtcagaatttttgcatcctgaatatatggtttgaagtcacggctgctgacaaagtagtcgatacgccaaccagcgttattagcgcgggcatggaatcgataactccaccatgagtaagtgacggtatctggatacaagttccggaatgtatcgataaagccgctatctaactgttttgtaaagtcagcccgttcttcatcggtaaagccggcgttgtggtgattggtcttgtcatttttaaggtcgatttcttggtgcgcgacatttaaatcgccgcagtaaacgagcggctttttggccgcgagttggttcgtgtaggcaagaaaatctttgtcccattgctggcggtaatccagacgcttcagttcaccaccagagttcggcgtataaaccgtcatcaaatagaagtttggatactctaaggtaatgatccggccttcagtatcatgttcaggaacgcccatcccatacgtgacattgagcggttcatgtttggtgaaaatggccgtaccagaatagcctttgcgttcggcgtagttaaagtattgatgatagccaggcagatcgagttcaacttggcctgcctgcattttggtttcctgcaaacagaaccagtcggcgtctaattcattaaaaatagtcataaagtctttttttaaaacagctcgtaagccattcacgttccaagaaattaatttcatcaaatgattcactcctaacgatgcattgcggttccattctactagatttgacagatgattgcgatataccttcacagcctccccgtgttcataacagcaattatctgctaaaatagcttagtagtatttgtgaaaggacctgatgttgtggtggatgcgccgcgtacgcttgaaggaattaccatgatgcatgatgaacctttgagtcattatacgtttacgaaaaccgggggaccggctgatttattggcgtttcccaaaaatgtggccgaagtgcgggcattagttgatgccgctcgtgaccggggcttgcctttgacggtgattggaaatgccagcaatctaattgtccgggatggtggcattcgcggactggtgttgattttaaccgaaatgaaaaccatcacggccagtggcaatcaagtgacagctgaggcgggggcgcggttgattgatacaactgaagcagcttaccgagcaggtttaactggtcttgagtttgctgctggcattcctggcagtgttggcggcgctgttttcatgaacgcaggcgcttacgatggtgaagtctgcaacgtcatcagcagtgttgacgttttgacgcgagaaggcgaattaaagacgtatgatcaccgtgaactgaaattccgttatcggcacagtgttgttcaggatacaggtgatgtcgtcttaagcgctacctttacgctcaaagcgggtgacaaaccagtcattcgagcaaaaatggatgagttgaatgcgcgtcgggcggctaaacaaccacttgaatatccttcttgcgggtcggtctttaaacggccaaaggggcattttgttggcccaatgatccaaaaagctggtctgcaaggtcatattatcggtggggcacaggtgtcaaagaaacatgctggcttcatcatcaacctcggcgatgcaaccgcaacggattacctagacatgattcatcttatacaaaaaacagtgaaagctaaatttgatgttgatctggaaaccgaggttcgaattatcggtgaacctggtcaaccaaaatagaccttaggaaggggcgacacaatgcatttagtcgaagccgttttgttcttgatggcacttgtcatcgtctcaaacgtgctcagtcactacattgtggctgtcccggtctccttgattcaagtcgcgctgggattaggcgcggctttgttttttcatttggagatcaatttagcgacagactggttcatgctgttgttcattgctccgctgctattttatgacgggcgtaattttccgcggcgcgagttatgggaactgcgtggtccgattatcggaaacgcgatttttctggtatttgtcacgatgctggtcggtgggtatctgattcactttttgattccgccgatgccgttgcccgcaagttttgccttggcagcgattctcagcccgactgatccgatcgcggtgcagagtctagctaagcgagttcatctaccaaaaggtgtgctgcatctggtgagcggcgagagcttgatcaacgatgccagcgggctgatcggttttaaatatggcattgcggcgaccatgacaggtacatttgtccttggcaacgccgttcgggatttcttttatgtggcaattgtcggtgccttggctggactggtgttaatcagtttaatcaacctaagtcgcaaatggctgctgcagcaagggattaacgatgtcattttgcatactatcttgcaggtgctaacacctttcttcatctatctcgtggtggacgagttcatgcatgcgtcgggtgtcattgcagtcgttgtggcggggttgcttagtaatactcgctacaaccgttacattgctgccttgccagaacttagaattgtttctgaacgtacttgggacattattgtctatacacttaacgggattatttttctcattctcggcattgaattgccggttgcgatgaccgacacgattgctgatcatgaggtcagcacgtttcaggcgctcggctttgtggttgtcgtttacctaggcattttaattgttcgaacgctatggatttacggttacatgctgctggtaaaacggtccaaagaaggcaaagcttcatggcgagcagctcttttgagcggtatttctggcgtgcgcggcgcgattacattagtcggggtgcttgccgtcccagcagctttgagcaacggtgatgcatttccggagcgtagtttaatgttgttcatcgcggctggtgtggtggtgctaagtttaatcgtcgccattatcgctttgccgttagttacccgttcagtggcaccactgcaaacgcgtggatccacgattgtaactgacgacagtggcgatcaagatgatgatgacagcaacgatattcgtatcatttcgatgagtcaggcacaaacctttgtctttcaaatggcggttcgccgagttgagtcggagcgccgtgagacgaatcaaaaagccgctttggacttgattgcggaatatcagtacctgattcgccggttagaactcgctgaagataccggtgctgccattccaccgctcattcaggatgaactggatctgcgaaaagtcggggttcaaggcgagctatatgctttagacgatctatggcgcgacaacaaaattatgtccaaaagttacgctaaagcccgcaaacaattgcaacaccgcctgaatgatctggactcaatggccaaacgctccggccgaccaactttccgcatgttgttcgaacgttccgccttacgcttatcgcattggtggtacaccgtggccagcgagcaaaatcgttcgcaccgattcttcaacgagcgcttatttattgaaaaagaaaccgcaaaaggcggacttaaatatttatcgcagtttttacgacaaaaggagaacaaagcccacaattataaccgccaagttatttatgctttgattgtccagtatcgaaatcgaattgcttcggtgaaggctttgaacacgcacaaatcaactcaatatgagcaggaactcgggcgcttgcgagctattgcgtttgcagctgaacgggccgctatccacgatctgacagaaaaagggtatatcacgatgacgatggcgcaaaaactgaatcaaaatgttaatttcactgaaaatgcggctaccttaacgtcacttgaagaggtttaagggccgctgcggacaagtcatgcctgttccaaaagagcgtttggttgggtcaaatcagttggtttttgctttttaaaacagacgttaattgacaacggtatcgtccttgtctcgattgagactgggccggtaccgtttttttgatgtccatgacatacgtatttgtcggcgctttgtgaggattcggcgaaacttttttgacgaattacaaatcaaatacttgcgttgttggttggcactcgtataataggcagagttagtaaacttaaagtttagtttaacgaaacccacaaaggcggtgtcttatggagattggcagtcgaattcgagacttgcgaatccggaaaaacttgacccaagaagagttaggcgagcgaacggatctaacaaaaggctatatttcgcaggtggagcatgaccagagttcaccgtcacttgagactttttttgatattttgagtgttttaggtgaatctccggctgatttttttcgtgaggaaccaaaagattccttggtttatcacgaggatgatcaagtcacatatttggatgaagaaaaagggtaccgcttgaaatggctggtgcctgaaagcaatgaaaatgaaatggaaccggtcatgatcgattttgccgcgcacggcatttttaaaacgttcgagccttcaccggcagaaacatttgtttacgttgttagtggtcgtgtcaaattactgctgggtgaacaaacctatgttgcaaagaaaggcgagacaatttactttcacgcaaccaagcaacatcaattggtcaacgccgcgacgggtcgtagtaagtgtttgctagtcgcgacggcatcttatttataaggagttggggtcattgagcaacattatcgttgaactgaagcatgttggtaagcggtacggcgacacgcaggtgctgaaggatatcaacattgagatcgaacaaggcaagttttacacgttgttgggaccatccggatcgggtaaaacaacgattttgcgtgcaattgcggggtttttggatgtctcagaaggtgaagtgctgtttgatggcaaacggatcaatgatgtgcctgccaaccagcgcaaggttaatacggttttccaagactatgccctattcccgcacctaaacgtttttgacaatgttgcattcgggttgcggttgcatcggatgagcaagcaggacattcagacaaaggtcgaagatgccttaaaaatggttcgattacaaggttatgctgatcgggaaatttccgaattatccggtggtcaacaacagcgagttgccattgctcgagcgattgtactcgagccgcaagtattgctgctagatgaaccgttatcagcacttgacgccaaattgcgtaaggatatgcaatatgaattgcgcgaattgcaggaacggttggggatcactttcctatttgtgacacacgaccaagaagaagcgttggctttgtcggacgaaatttttgtcatgaatgatggtgaagtgcaacaaagtggtacgccagttgatatttatgatgagccggtcaatcattttgtggcggatttcattggtgaaagtaacatcattcaagggcacatgattaaggactttttagttgagttcaatggcaaacggtttgaatgtgccgatgccggaatgcgtccaaatgaaccggttgaagttgttttgcgcccagaagatttggacattaccccagcaaattcaggcaaggtcaatgttgaagtagacacccaactgttccgcggtgactactacgaaattgtgggttacgacgatctcaagaatgaatggttgattcactcaaccaatcccgccaaagacggcgaaacggttggcttgacgtttgatcctgaggacatccatgtcatgcggcttaacgaatctgaagaagatttcgacgctcggctggaaacctacgaaggggaataacgtcagtaaggatcagttggggcagtgtcatcgaagcgttttgacgattagatagacactggtcggcgctgatcgattttcgaactgaggagggtcatcgtgaaaaaatccaccacaaacgccgcattctacacaccttatgtgatgtggctggcattatttgtgatcgcaccgatggttttaatcgtttatcaaagtttctttaacatcagcggtcactttacccttgctaattatcagacctattttcaatcaggcacttatattatgatgacgatcaattccgtctggtatgcgttcctgatcacgttagcaaccttattaatcagctatccgacagcatatttgctgcattatgccaagcataaacagttatggttgttgctgattattctaccgacttggattaacttgctgctgaaagcatacgccttcatcgggatcttcagtcaggatggcggggttaatagtttcttgggaatgtttggcatcgcgccccagcaattcctgttcacggattttagtttcatttttgttgctgcttatattgaaatcccgttcatgatcttgccgattttcaatgcaatcgaagaattaccggaaaaccttgtcaatgctgcccaagatttaggggccaaaagctggcagactttcaccaaggtgatctggccgttgacaatttccggcgtgaaatccggggttcaagctgttttcattcccagtttaagtttattcatgttgacgcgtctgatcggcgggaaccgggtcattactttggggacagccattgaagagcattttctgacaacgatgaactggggcatgggttcgacgatcggggttgtcctgatcgtcgccatgttcatcatcatgttcctgaccggcgaacgtaagaagaagggggcgcggcgtcatgaagcgtaaattcaaatggtccaacctttatctgatcttcgtcttcatctgtttgtatgtgccgattttttatttggttatctactcgttttcaacgggagatcgcatgagcaattacagcggcttcacatggaaacattatgctgagctgtttgccgacacccggatgattcaaattgttctggatacgttgctagtcgcgctattatcaagtttgatcgctacgattatcggtgcgttaggggcattagcaattgatcgtactagtcgatctgttgttaaaaacacggtcttatccctcaacaacattctcatggtgagtccagatgtcattatcggtgctagttttctgatcttctataccgcgttgaaagtgccattgggtttctggtccgtcttgatgagccatattgccttttctatcccgattgtcgtgttgatgatcttaccgcggcttcaggaaatgagccattctttattagatgctgctcgtgatttaggcgcgtccaactatcaagttttaacgcgcgtgatcgtgccttatattacgcctggtattttctccggctttttcatggcctttacgtattcactagatgattttgccgtgaccttctttgtcactggtaatggttttgaaacactggcagtcgaaatatacgctcgcgcacgacaaggcatcagtttggagatcaatgcgttgtcaggcgttatgtttatctttgctttactgctggtagtcggttactacttcattcaacaagcaggtcaaaatcggcgagccaaacaaaaacacaagcgagaaagcgaggcgttgatcaatgaaacgactcattagtattgcgattgccatcttagctgtttgtctcggattagcagtttggagtgaagggttacaaaaatcgcaaggtgacacgggtgaaaacacgttaaaccttttcaactggggcgattacatcgatccggcgctgatcagcaagtttgaaaaacaaactggctatcatgttaatcaagaaacctttgattcaaatgaagccatgttcaccaagattcaacaaggtggtacaagctacgatttgacagtaccatctgactacatgatcgaaaaaatgaaaaaggccaatctgttgctaccgctcgataaaagtaaattacgcgggatgcaaaacatggacccgcgtttaatcgataaagattttgatcgcaacaataaatacagcattccgtatttctggggaacgctggggattatttacaacgataagtttgtcaaagccagtgaagttcaacactgggatcaactatggaacccgaaattcaaagattcaatcatgttgattgattcggcccgcgacgtgtttgcaccagcgctcatttcgatgggcaagtcggttaatgaaaccaacccgcaaactttagcgctcgccaaggcaaaacttgatcagctgtcgcctaatgtgaaagctgttgttgctgatgaaatcaaaatgtacatggccgagaacgaggctaagattgccgttgactggtcaggtgaagccagtgagatgttggccaacaataaacatctgcactatgttgtcccgcgcgaaggcagcaatctctggtttgacaacttggtcatccctaagacggctaagcattttaaggccatctatgcctttctaaacttcatgatggaacccaaaaacgcggcccaaaatgccgaatatgtcggttatgcaacaccaaatgcagccgccaagaagcttctaccaaagagtgtgcaaaatgatcgccaattttatccagatgatgaaacaatgaaacatttggagatttattctgatctgccaccagctaaggttgggctttataatgatcttttcttggaattcaaaatgtatcgccgatgagaaggctcatcgcttacagtccgctatgattagctgaaaatgctaatttgcgggctttttttggggtcactttttcgattgcttcggtagtcttaaatgacaaggatttaactgatgatctcgcaaaaaataagccttgataacaaagagcgatgagggaaaatggctttaaagatgagaacgttttctaaaatgcacatcacactagcaaaatctggtacgcttattgcaatgaaaaacatctgattgtgccccagcgtcattaactgacaaagggataaacggttttgcagtcgtcttggttacttgtttcagatacgatcactaagaggtgggcagcttgggaaagagaacttacaaaaatgaagagcgctgggtagacgttgtttgttgccttagtctttggttggcatcttttagtttgatggcagccgctacggtactcgatgtcaatcgtccattcttcattattatgctgtcattaacggcctgcgccattggcgaaacggtgacgttggttaggaaaaagcgctgaggcggatgataagattgtttaatggtatcacgcgtcacggtaaaatgggccagtattagctgtgtcttttcagtgattatttttgtgactaatcaaccaataaccgaccacgaaaaatatagttccaagtgttgcaattcctaaagcatcgagcaatatggaagcgataaagccattccgaatgacaaaccatacaactgcactggcaaacatcacgcaccatcctccaacaaaacttagaccaacaactttatttgtttgcatcaatttaacctccagtagtagtttaagttgccaatgagaatgctttctatcttatagaaaggataacatgaagctgaaaattttggttacattttttaacataggggcagtgatctttcggctttatggcgatttaatgcacgccacttcgcacacaataaaaagcgatccgcctatttttggacggatcgctttttgttcatattaaccgctattacctaatcaacaacatcgactttcttagcagccaatcggcgtcgattgagccacttgcgtccttcttcgatgaggaagagcggaattggaataatagccaagaagatccaatccgttggggcgagtgggccggtgtgaaagagttcctgtaagaatggggtatagctgagaagtgccaataggaaaatttcaaagacgatcccgaaccaaacgagtttgttagcaaaaagaccggctttgaaaacagaagcattttcggttcggcagttcatcgctgcggcaatctgacagaagatgatggcggccaaggtcatggtagtcgccatgacgtaagtgttgccactggttgccagacccttcaacggccagccattgagatggttgacgaagaagtaggcaccgcttgaaatgattgaggcaatcaggccataccaagcaaacgccttccagagaacggttttactcatgaggtgggcatcgcgtgctcgcggtggcttgtccatgatgccaggttccgctttctcagagccaagacctaaggctggcatcatgtcggtgccaagatcgacggtcaaaatttgcatgacagtcaacgggagcggaatcgcaccacgtgagaacaggaataaggctgaaggtaccgcttcaggcaagttagaattcaagatgtagatcaggaatttctgaatgttactgtaaacggttcgaccttcttcaatggcggcaacaattgaggcaaagttatcatcggttaggatcatatcagcggcatccttggcgacatcggtgccggtaacgcccatggcaacaccaatgtcggcttttttcaaggctggggcatcattgacaccatcgccggtagaagcaacgatctcgcccatttcttgcaaggttgagacgattttgtatttctgctctggggcgacccgtgcgaaaatgatttcgccagcaagtgccttttttaaatcttctttactcattgaatcgagttcgccaccggtgacaacccgcgctttgtcagaagtgaggccgattttgaccgcgacggacttagctgttaaggaagagtcgccggtaaccataataattttgatgctggcacggtgacatttcttgatggcttcgtaaatttccggacgtggcggatcggacatgattgctaagccaacaaaggtcaaattggtttcggccgtgtcgattgtgaggccgtcaagttgtttttctttatctgtttcttgaggcacctcacgataagcggtggcaatggaacgcaggccgagggaagcatatttgcggttggcatcgtcaatcgcttttttatcgtcttcagtcagtggccgaactttgccattttcttggatagtgtcacaatgcggcagcaaatcgctcagcgagcctttggtgcaaattgataaggtgtgatcgtcatgttgatgaatggtggtcatacgcttccgatctgaatcaaacggcagctctttcaggcgtggatacttaatgctgtatgccttggtatcaatgccggacttttgggccaaaatgaccagtgaggcttcagtcggggtacctaggattttcggccgagcactgccttttgacggctcaacttcagtatcattattgaaggcaactaagcggatcagcaaatccagatcggcatcggtgccatatttaatgggtttcccgtccagttgaatctggccattattcacgaagccttggccagtaacggtgaaggaatgagcaggtgtccagatgtgatccacggtcatctgattttgggttaaggtgccggttttatctgaacagatcaccgtggtttcgcctaaggtttcaacactattcagatcttttaacaacgcatgctttttggccatgcgttgaacgccttgagccaaggacaatgtgactgttggcaacaagccttcagggatgaaggctacgatcatacccaaggcgaaaatgaaactttgagccacagggtagtggacaaagaagattgccgaaacgaagaataccagaccaagaccgatagcaatcagtgaaatctgtttggttaaacgatttagctctaattgtaagggactcagacttggtttttgttgttgcgttaacgccgcaattcgaccaaactcggtattcatccccgtggcaaatgccactgcagttgccgtgccagcgccaacagtagtgccagcataaacaaggtttgattccgcgaactcaccttgaccagcatcaaaggcaactttttttgattcaggtaccgattcaccagtcagggcactttgatcaacttgaaccgaagtggccttaatcaagcgcgcatcaaccggaaccgcattgcctgcctgaagattgaaaacatccccaggtaccattttggttgcattaatttgttgcagtttgccatcgcgataaacttgcgtataagccggtagcattttcattaacgagtcagttgctttttgagcttcatgttcttgccaatagctgaaaacaccgttgataatattgaccagccaaatggcaatccctaattcgagggtgcctgacaggatggcgacaaagccgctgacccacaacagaatggccatcacgcttgtgaaatttttgaggaaaatgagtaattgtgattgttgcttttcccgagtaatcacgttttccccatatttttctaggcggtcgtcggcctccttctgcgttaatccagttgacgttgtgtgcaaatccgtcatcagatccgggacgggatccgttgcaaacttgcgccgcgtctccttttcatttttcatgacttaagcacgtctccttcataaagatgtttagcttcattctaacgttctgagcggcggaaaacacccaaagtgctgtttttaagtaattaaacttttcggcttaggcgcggagaccgcgttctaagaattcaaccgcttcgtgaacggcagtttcgagatcaaaagcggattgttcaccgataatgagtggtaataggtaactaagcacggttccaaaaatggctcgtaggactcggttaaatggccaatccaccaattgtccgttagcctgataagttgcataaaggcgcgcggcttttcccgataactcgtggttgaattgctcagcgagctcttgtcctaaggcagcatcacgaagaacagtggctgctaaaacccgtagctgggcttgattagcaatggcaaactgcatacgatcatgaacaatgaacgttaaaaaagtgtgtaagtcgggcaaatcttgttcaccgacttcattaacaaactcggttaatacgtttggcattacttggcgaatcataggggctagtagcgcctgaagaatcccatctttcgtcttgaactgcttgtaaactgtgccttcgctgacctgtgccgtttcagcaatttctttagtgctagtgcgatcaaagccttgactagcaaataacgctaaactggcctttaaaacggcttgctgtttagcggatagattgcttttggcaagtgaagcggaaaacaaatcggtaatattacgtgtgtgcatcgcgagatcgcttcccttcaataaaaattgctcgactttatacttgccggtattttcgcatcgtgagtagatttaatccaagaaataataggaagaatccgaataaagccaacacatccggatagaggacggcaagcgactggcctttggcgataataccggttaaggcattagcaccatagtataaaggcatgatgtgagcgatgggttgcagccacccaagcatgtgatcaattggaattaatcccgtaaagaaaatttggggaataaccacaattggaatgaattgcagcatctgaaattcagtgttagcaaaggttgaaaccaacaagcccagtgccaaggcagtgaacgctaatagtaaattgatcaaaaagatggcggggatgctgccaagaatttgaattttgaatacgatcaaggaataaccaacgattagcaatgtctgaataatggcgaaaataccataacctagtaggtaaccgctaatgatttcaccgcggcgaaccggcgttgccagtaaacggtataaggtgccagtggtccgctcgcgcaacaaagcgatgcccgaaatcaaaaagacaaagaagaagacaatgaatcccattaaaatcggcaacagggtgtcaaagtaagttgagtcggctgagccatatcggtaatgggttgttaacgtgtaactcggtgtttttggttgatggggttctggaatctgggctgcgccgcgcgtggcctgtttgagagctgtcgcaagcttttgtaaggtggttgcttggatcttaagccctgtggctgcggcttgcatttttagtttgatagaagcggcttgcaaggtttgtttcagaatcgcgctttttccttgatcagcgttggccaacgtcagggtcagcttatcgccatcctgcgtgagcacaccggcataatcatgagccttgattaatgcgatgggttggtcattattgacctgatgcaatcgaacgtgtttggtatcgatcgcctttgttagtgacgaatcaacaccatgaactgccaaatcagccttggtgtccgtattggattgaaaaagaaaaaagatcaacgtcatgataaataaaggcgcgataaacatcagggctaacgtgcgcttatcgcggagcatttcttttaaaatccgattaatcaacgcttcaatgcgcatcttgctgcctccctgcggctaagaagaccgcttcaatcgagtccgtttgataatctgcctttaattgtgccggtgtcccttgggcaatggcagtcccgttgcgaatcatcaataacgtgtccgcttcttcggcgtcagccatgacgtgggtcgttaaaataatggcgacaccctgatccgccagacgatgcaattcataccagatttgttggcgcagctcaggatcaatgccaacggtcggttcatctaaaatcaacagctgcggttgactgatgagggcgatggcgagcgataatcggcgcttcatcccgcctgaataatccttaactggttgctttaaggccggttgcagattgacgacattagcagcataagccatttgtttggtaatctgcgcgtgtgggacgccttgcattttggcaaaaaatgtcaggttctcggcaccggttaaactttcatataaggcatcagtctgagccatgaagccgattttcgcgagtagggggcgattcggcacggcttgccctaaaacgctgacttgtccggtgcgtgggcgcaacatacccataatggtactgactaaagtggttttgccagcaccgctaggaccgattaaagcaagaatttgaccatgatttaaggtcaagttgatgtccttaagcacgatctgtttaccatagccttgggtgagggcgctgacctgaacagcttgatttgtttgcatattatcgcgtcactttctcaataatatagtgagtgctcactcacctgccattatcgccaattttggggtaaaagcaactaaaagtttaaaagtcatcagccaaatcaatcggattgttgtcaaaaggatggcatctaaaagctgcttcaagctgtgttatagcgactgaaaccgcttatgctcccgtttctggccgcgcctgtgcacacctcgtggtataattattcagaagtttgattctaaaccataatggaggaacgcggatgcgcacctatctgacaaatttattaacttggtccaccttgatcaatctggttgacatcctcgtcgtctggtatgtcatttatcgtttgatcatgcttgttcgcggtacaaaagcggttcagcttctgaaaggcgtttttgtcattgctgcgatcaagattatttcttggttccttcagttgaagacggtcggttatttaactgatttggttattacttggagtgtgccagcactggttattatttttcagccggaaattcggcgtggccttgagcacctaggtcgcggttccttgatttttcggtcgaataataaccagcacgaagtcgaagtacggatggtcaaagaacttgataaggctattcaatatatgagcaagcgccggatcggggccttaatgacgatccagaagagtaccgggctggaggattacattgagacaggtattcccttggatgctgatattagtggagagctgctgatcaacattttcataccgaatacgccgttgcatgatggggcggtgatcattcgggacaatcgaattgcggttgcggctgcatacttacctttatctgacagcaatctcattcctaaagaacttggtacgcgccatcgtgctgctgtcgggatcagtgaagtgaccgatgcgttgacgatcgttgtctctgaagaaactggggaagtgacgatcacaaataacaacaacctgattcgtaatttgacgcgtgatgactatatgaagtttctgacggcgcagttagtgccaaaagaagaggcgccgaatccgaacccagttgtcagtttcttttcgcgccggtttaagtcacgtaaaaagaaggagggcaagcaatgaatcgcttatgggataatccatgggttaatcggttgttggctctgcttctcgcgattgggctttttgcttatgtcaacgttgaaagcatcaacaacaccagacaaagtgcaaatgatgatacaaccttggttgccaacaaaacccagaccgtgaaagtgccgttacaggtaaatgccaacacggacaagtattttattaccggttatccgtcaaaagtttcagttgcattgacaggaacggcttcattagtcacgatgaccgccaacacccaaaattttcggatcattgctgatcttaccaaactcggtgttggcaagcatcgtgttcggttgaaggcagaaggtttgaataaggatttgagttattcgatttcgcctaaatctgtgaccgttgacattcaggttcgggacaataagacgatgccgattcaggttcgctataataaagccagtatcgcatccgggtatgcagctggtgagccaaagctgtcgacgcgaacagtggatgtcactggcgcacgatccgtgattgactcgatcgcacaggttgtggcaaatgtctcgctgtcgcacaatacccggagtacggttgaccaagaggtgctgttacaggcgcttgatgagaacggcaatacgatgaatgttgtgttggcaccgcagactgttcatgtaaccttaccgatttctcaacctagcaagaaacttaccgtggagctaaaacaaactgggaatgccgtgccaggacgcacgtatgtcttgtcctctgacacaaaacaggttaccgtatacggagaccaaagtagtttggacaagttgagtaaattaaccgtggacgtcgatgtcagcggtattagcacgacgacaactcggacttacaacgtgactgatttgaatgatggcatttctgctgctagtccgaaatcacttaaagtgacggttagtgttggcaacactggtaatgatgataataacaacaatggcggttcaacagcgagcgccagtacttcgagttcgagcgccgcaagcacctcgagtgccagtgaatcagactcaagtacatcaacaagcgacaataatggctgaaagaaatgaggaagaattaagatgacaaagtattttggtactgatggcgttcgtggcattgcaaacaaggaactaagtccggaaatggctttccggctagggcggacaggcggctatgttttgacgcagcacaaagaagatgcgagtcgacgcccattggttttggttgctcgcgatacacgaatctcagggcagatgttggctgatgctttaattgctggcttgctttctgttgggattgaagtgctggatttaggcgtgatcacaacgcctgctgttgcttatttaatcaagattcaaggcgccgatgctggtatccagatttcggcgtcgcataatccggttgccgataatggcatcaagttctttggagcggacggctacaaattgtctgacgatactgaagaagaaattgaagccttactggatgcgccagaagacaaacttccacggccggctgctgaaggattaggtacagtagacgattatcctgaaggcgcactcaagtacacccaatttcttgagcaaaccttggcagatgatctgagtggcattcatgtgtgcttggatggcgcaaatggtgcaacgagtgggttagttagtcgaatttttgctgatcttgagaccgattttgatacaatggcaatcagtccagatgggcttaatatcaatgctaacgttggttcaacgcatccgcaggcgttatcgaaatttgtcgtcgaaaaaggtgctgatgttggcctcgcgtttgacggtgacggtgatcgctgtatcgcagttgatgaacaaggcaatatcgttgatggcgacaagattatgttcattctcggtagttatatgaagtcacagggccggctgaagcaggatactgtcgtcaccactgttatgagtaatcttgggttatataaggcattagaagcgaatggcatgaagtccgtgcaaacggccgtcggtgatcgccacgttgtcgaagccatgcgcaaagatggctataatattggcggcgaacagtctggccacgttattttgtttgattatcacaataccggggatggcatgctaacaggcattcacttgttaaatgtcatgaagaaaaccggcaagaagttgtctgaattagccgcacctgttcaagactatccgcagaaactggttaatgtgaaagttgcggacaaggaaaattggcaagcttatccagaaatccaaagtgccattgataccgtcgaaaaagaaatggccggtgatggccgtgttctggttcgcccttcaggcactgaacctttgttgcgggtcatggccgaagccaaaaccgaagatttggtttcccgttatgtggatcaaatcgtggatgtggtgaagcaagaaatgggcagcaaggaagattagctgctgtctttatcaaaaatttaaactttattttaaccgagttgtcacgggtctcatcgacaactcggtttttttgtctggtgatagcattcgcaattggcacactttgaaagcgcgttcataaaatctcaaagccagtgtgcataagaattgggtaaattaatatagaccaatatatatgtttcaagtataccagtgaaaaaatggtgttgacatatagcctattaaaaactatagttagctttgctttcaacaataccaataaaaaaatctgtctaaaccaatttttagacaaaaatgaaaaggatgttgactatgtgtggaatcgttggcgttatcggtaaaaagaatgcaacgcagatcttgcttaagggattagagaagttggaataccgcggctatgattcagccggcatttacgtgaatgaccaagccggccatgatcatttaattaagcgcgtcggccacatttccaatcttgaagaagcggttacgcctgatgttcaaggcgttatggggattggccatacgcgctgggcaaccaatggcggccctaccgaagccaacgcccatccgcatgtttccaatgacgaacggttttatctggtgcataacggcgttgtgaccaatgctaacgaactgaagcagcagtacttgcaagacattgaattacagagtgatacggataccgaagttgttgttcagctgattgccttgtttgcccgcgaaggtctgtctgctaaggaagcactgcgcaaaaccttgaaaatgatccaaggttcttatgctttctcgatggttgatcgccttgacccaacagtgctgtatgttgctaaaaacaagagtccattactgattggccgtggtaaaggctttaatgtggtggcttctgatgccttggcaatgcttagtgaaaccgatcagtttgttgaactgaaggatcaggaaatcgtgaccttgacggctgatgccattcacattgaaacgattgacggcaaagttgaggaacgtaagccattcaccgttaaagttgatgatggtgaagtttctaaaggtacgtacccattcttcatgcttaaagaaatcgacgaacagccaatcgttatgcggcgtttggtcgaaaagtataccgatgatcatggcaacatcgttttgccagaagatttgctgaaagctttacagcaagctgatcgtttgtatatcgttgcggctggtaccagttatcatgccggtttagtcggtgcacctttgttcgaacaattggcaggtattccgacagaagtgcatgttgcttctgagtttgcctatcatcaaccactgttgtccaagcacccactgttcattttcctaacccaaagtggggaaactgctgatatccgtcaggtccttgtgtcagtcaaggaacgcggttatcagacattaacgatcacaaacgttgccagctcaacgcttgctcgtgaagcaacctttatgttgcagttgcatggcggcccagaaattgcggttgcttctaccaaagcttacacggcacaaatcgccgttgaagcgctcgtatcgaaagcagtcggcgaggctaaaggattgcaggctgctaaggacttcgatgtgatccatgaacttgggttggcagcaactggtcagcaggctttgattgaccaaaaggatcgcatccatgaactagcaactgacatgttcaagaccacgcgcaatgctttctacattggccgtggcgatgattactatgccagcatggaagcagcattgaaactcaaggaaatcagttatgttcaggcagaaggctttgcagctggtgaattgaagcatggtacgattgctttgattgaaaagaatacgccagtggttgcaatcatttctgatccggttacagcagcgcgcactcgcagcaatgcggacgaggtgcaagctcgcggtgccaaggtgcttcatatcgcaatggctagtcaagcccaagatggtgaccaaatcgttgtcgatgaaatcaatccattacttgcaccgcttttgacgattatcccggcacagctcttggcttactttactagtgcggatcgtggttacgatgttgaccgtccgcgtaatctggctaagtcagtgaccgttgaataatcgctaagaatttcatttggtgatcggtgtcattcatgtcaagatgtggattcaatccccagcttggtgtctgacgttgtagcggatcgtgatccatgtatataaaaaagtgttgcatcacgggcatcctcgtgatgcaacacttttttaataagcacaaattaagtatttgtgcgctaagtgacacgttgcaaatcgggaagaactttatttcaagtaaccttcactcaaagtcataaactgttgcgcatctttggcggctaaatcaatgccttgctgccagaaatccggttgcgttaagtcaaccccgagatgttttttcgctagtgcttctgttgtcatattcgccgtatcccgcaacaaagcaatgtaatcatcttcaaaattatcagatgcttgggcctttgcgtaaataccgctagagaacagataaccaaaagtgtaagggaagttgtagaacggtgggttgtcgaagtagaaatgcagcttgtctgcccaatacatgggatcaaaagaacttagaccacctgcataggcctgttgttgcgcagtcgtcataagttctttcagtcgtggcacactgacaattcccttttcccgttcctgatagaaactgtcttcaaacaggaagcgagcatggatatttaacagcatcgccaatggattggccattttagcgtctaacaaattaagtttctcagccggtgaggttgctgctttgactgtggcatctgcaacgattaattctgcaaaagttgatgcagtttcggcaacattcattgcataatcttgacgcagtagcggcatatctttcaaaatactgctgtggaaagcatggcccaattcgtgggcaatggtggaaacaccagatgctgaaccatcgaaggtcatgaaaatacgactttctttgacatctgggacgctggtcatgtaaccgccagcgcgcttgcctggccgatcttcagcttcgatccagccattttcaaatgcctgtttggcaaaggcagccattttaggtgagaacttggcaaagttgttcacaataaattcggcggcctcatcgaaggtataggtctttggctgaaaatcgcccacgatgactggcgcccattggtcataccatggcattgttggcttgccagttaattcggccttgcgcgtgaggtaagcagcaaaaggctgtttgttggcgctgatggtgtgccacatttgatccagcgtggcacgttgcatgcgattgtattgcaacggcttgaaaagataatccggataatgatgcaaccgataattcgtaagccggaagccggcaatgtgattcagggtctcaccaaacagactggcatgatcgtcccacgtttgttcccaaacgttaaagacttgttcacgcgttttagtgtcaggatcgccttcgaatttattctgggtttggccagcactaagctctgtggttttgccatcttgtgtgattgggaacttaagactgccactcaaggtggtgtaatgatcgctccagccagtaaaaccatcgactgccagatcgttaatcatcgtttcggtttgatcatctaacagttcctttgcctggtcgcgcatttcttgcaagccaaaacgactagcgcttaaagctgatgtggtcgttagctgatcgaaagctgcttgtgacatggctgcgagttttttggccagcgggttgttaatgttttgaaaacgggtataaagtgtcgtgagctgaccttgaacaggcccggttttcagattagctgtatcagcgctggcaatcatctcgacgaagctgctagtagtagcgaggcctttgccaatgtcttccagcagttgccaaagtgtgatgaaatcggtaaactcaggagcatcgtggtcaggggcccaagcggctacttttgactccagttgaggcaatttggccgtcacatcgctaattcggtcggcaagttgcggtgagtcgataccaccggggaaaatcgaatcgaggttccagttaattggataagacatattggcacttcctttcgaaatagctttattataccgtagatgagaaaagtctgagtgaaagcaggtagaagtttgtgacgtcttttaaaaaacattgggggttgtggctggcggcagtccttttgtttgtcttgttctttagttccagtatgacttacaaagagcaaacaacggtgccgttattggaacgcttgttacacaatgaaccgtttaagcaagccttaagtgatattcattttaattatgcgggtgaacagcaatcaattgctgaggtaggttattttaaatttgttgaatttttcattcgcaaaggtgcgcatgtcagcatctttttcctattaggtcttggtctgacacaaggcacgtttatgtatcagaaaaatcgttggctgcattggccgctaatggtcttaagttgtaccggtgttgcggcatttgacgagtttcatcaaatgctgacaggcgggcggacaccgcttttccaagatgtgatgctcgatactgctgctgcggctgtggccgtgaccttaatgtggttatggttatggcggcagaagcgtcattgaataaagtgccgatctttgctataattttagcgattcatatgctcctaaacttacgaaaagagggtttatcatgtcaggacattccaaatggcataacattcagggccgtaaaaatgctcaggattcgaaacgtggtaaaattttccagaaattatcacgtgaattatacatggcagcaaagcaaggtggtcctgaccccagtggtaatccttcccttcgtttagtcatggacaaagctaaagctgccaatatgccaaaagacaatattaagcgtgctttagataaagcaagtgatcgtgatgcggccaactatgacgaagtgacctatgaaggctatgggccaggtggtgtggcgattttggttgaagctttgaccgataatcgcaaccggacttccagtaccgtacgagtggcgatcacccgacacggtgggaacatggcagctgctggtgcggtttcatacatgtttgatcgaaaaggttatctggtgattagccgtgatgaccttgatgttgacgaagatcagatgctagaagatgcgcttgaagccggtgcagaagatatgcagacttcagatgaggcatttgaaatctacaccgatcctaaagaatttgctcaggttcgcgacgcgcttgaggaaaaagggtacaagtttgtccaaaacgaactgacaatggttccgcaaaacctgaccccgattccagaagataaagttgaacaattccaagctatgattgatcaattggaagacgacgatgatgtgcaggaagtttacacagccggcgactggccagacgattaatgcatcgattgatagctagtgatcaagacgagggaaaatcctcgtctttttttctgcccaaaatagtaaagaggacggggtgatatatgacgctcgcgaactcttttaatacagggggaaaaacgatgcaatcggtgaataagcttttgacaattgcgctggaaaagggtgctagcgatatttactatttgcctagtccgcaaggttatttgattcgcctacgggtaccgacgggcttggtaacaatcgccgagcgagacagcaaacgtgggcagcaagaaattaattacttgaaatttatggcgggcatgaatgttgccgaacatcgccgcgttcaattgggagccttttatcaaaaggaatcagcagcttttttacggttaagttcagtggctgactttcgcggtggtgaatcactggtagttcgcataatcaaaggcattccagatgctgcaggcgcacgtcatctgttagatcgtctgttgggtattttactgcagaaacgcggcatgctgaccctagctgggccgactgggtcaggaaaaacgacattactctatcagttagcgacgcgtttggcggaatcacgaatggtcttgtcgatcgaggatccagttgagatcaatcagccgcaattcttacagttgcaagtcaatccggaggcagacatgacctatccgcaattactgaaggcggcgctgcgccatcgaccagacgtcttgctgattggagaaattcgtgatcgacaaacagcgcaaagtgcttgcgaagcggcgattagcggtcacattgtcctagcgaccgtgcatgcccgatcagcggcggatacacccttaaggctgagcagttttggcttgccggatgagttagtagcggcggcattgacggcgagtgcggcgatcagtttgcagtatcggccaatgattcacccagtggcggaagtcgtggttttcaagcaagtagggcaagctgatcaggaggtggtttcgtgagcatgccgctggtgattcaggaacggttttgccgtcaaagcgctgcgttaattgctgctggttttagtttgccggatgtgtttgcttatttgcgtgtgagtataccgaaataccggcgaatttgggaacgaatcgaaacggatttggcttctggcatcggattgccagaagcagttggccatcaggcattagctcccatcctctttcaacaactgcaactagcacaggttcatggggatttggcaaaggcattggccgtggctggtgattacttaggcttgcgagtgcggaatcgtcagcggattggtcaactgttaatttacccacttgtgttactgggcatgcttgttaccttgcaagtggttgttgtgtttggcgtgttgccagccttggcgttaccacaatcgcatttagtgcatacgcagttaatgaccatgggtgggggcttagccgccgggttgttaatatggctcgggtggcatcgactgacgttggctcaacgcttgcaactcttacaacgattgcctggtgtccgtggcgtcatgcaagtgtactatcagtttcagttcacagccggagccgcccacttcttactggcaggtgctgagattgccgacttttgccgacacttgataaccgttggcggtccgttgggtgatttaggagcacgcattcaacaaaagattcaacaaggggctgagttggccgatgcgttacatgaagcctttgtgccacctgaagttgcccgtttattgacaatgggccagacacatcacttagtggcgaccggcttaaaactttttggtgaacaactatttttacagttgcagcaacgtttagaacgactggtgaacttggtgcagccattgctgtttttgcttattggtggcgaaattttactggtttatttgcaaattctcttaccactctatcaatctttcggaggatgaccatgcgacgcaaacgattacgggcttttacattgattgaagtgattgcagcacttggggtcattattttattgacgttagctttggttttgacaatccaagggcaaatgaaacgtgttgaaagtcagaatctaaaagctacggtggcaactgtgaattcacaaattgaaatggcctataacgagccggatgctgacaagaaatcacttaaaacaattcctgatttagtcagagaaggcgtgattaccgatgcgcaggcgaaggacttggaaaaaggcaaggcaacgatgagcggtgacaatccgccgaaatttaaagttccatgaaacggctgcgtggctttgtgatgcttgaagtggtggcggtcttggttgtgctagcgggtttaacactggcagccgttcctattgggcaaagtgtgattcgccgtcatcaggagaccaagtttatcgaaactatgcgggaacaatgggaatcaatggggatgaaggcatatgccacgcataaaattggcaccatgtctgtcaatgatgaggcacgtcaggtgacatttagtctttttaatggttcaaaacgaattttgccatttccgccatccttgaaatatgacgataaaattcctacaaaaacgacgagagaaccatcaggtaaattgaaaggcaaccgcagcgtaaattttctcagtcaagacggctattactggcatataaccctacagtttgaatgggggcggttcttattccaaaaagtaccaaaacattaacaggttctttgttaattgaacatcttgcagctctgggggtgctcttgctggcggttggttggttaatggtgttagtgcggttatatgaccgagttgtggttgaatccagacagcgaacgacggcctattatgcggcacgggtggcgcttgttcatttgccagtacgaggcggagagacgacggttcaagttggacctgatgtgtggcaagtaaccgtcaatacgcaggaggtaaaggcgcatgcccaaaagggtcgatcaacatatacgttcacgccttaaaggctttactttaattgaagtggtggtcagcctgattttacttgcggcggtcatgctgttatggcgaccggttttattgcatgtcacgcggttcacgcttcaagaccatgtgctaatcacgtcattgcaagcagagcatgacttgcaaatgtttgtacgagataaaaagttgcggtctgtggccttaatgtcggtaagggtgagaagtcccgagaaagcttacacgatcaatttttatcagaccaaacattttcgcggtatggttcgtgtgatgggatctgaaaatgggcatatgccattatttacgcatctaaccggtgtcaattttagcaaggtagctcaaggctttcgctatcgtctgtatttgacgacttcgcagaagattgacggtggggtgcaaatcgatgaagatacgcggtagtgttttgatcaacacactgatactgtttgctttactcctaatgctgactgttggcgcgatgcaacgttttcgtgattggcaggaaagttatcaggtgcttgaacaggtagaaaagcgccaatttacggaggcatacaaccattggcgagaacagatgtctgataaatcgaaaagcgaggctgattcctcgacttcagctggcaaggaatctgatacatcagctattcgatcagcgccgccagcgattggtgagaccaaagaagcgactaaggaacagcttgaatcaactcaatcagggattcacgcgcttgaataagcttttctcaatcggtacactggtaagcggagtgtcggcgatgaccagcacctgcacgcatcgttttttaggcctgaaaccgtattgatagggggaagcatcttggcccacgaacatctagagaagctgtacaatgttttggatgaaagcacgacaattttgcatcaacaattgaaaacatcttttattgctgctgttattgaggcgggagaggatcttgcgtcgggcaacgtcatgcaagaagacggtgttcccaacgatgaagctaaaaagaagctaacagcgttgtttgatcagatcaaactcgccacctatgagccggaagagattcgtcaagccattcaattagtgcttgttaaggcaatcaaggtagatggcattgaacccaataagcaagtcacgcctgatgccatggccagtcttgcgacatttatggtgacggtttttgcgcaacatctgccaaaaaagatgcaagttgccgatctggccgtcgggacggggaaccttttatttgctgtgatgaatcagctccacaatgcgcgtcaggtggcagtcaaaggctacggcattgataatgacgaaaccttattggcagttgccggcatgagcagtacgttgcaacagttagatgttgatctttttcatcaggatgccttagataatcttttgtttaaagacatcgatgttgttgtttctgatttgccagttggttactacccggttgacgaacgcgccaagcaatttgagaccgcggcggccaagggacattcttatgcgcatcatttgttaatcgagcaaagtatgcgggtcttgaagccaggaggactgggtttgttttatgtgccgagtcaggttttccgttctgaagaagcggcggggctgacagcttggctggcgaagtcgacctacttccaagggttattgaatttgccggaagatttctttgctgaccaaaaggcggagaagagcctgctggttttacagaaaccgagtccggatgtcaaacgtgctaagcagatcttgttaggccaatttccggatctaaatgaccgcgatgcttttgccacgtttattgacaaagtgaaggattgggcagctgctaatattgcgtgattgattgatttttaagtaacgaaaaaggagagctgacaaacgcttgtcttgtcagctttttttgtcatttcaaaacacttttcatcttgtgatagcaaggcggtatggctgctgtcacaggatttaggacgttagaatagactttactgatccggtcgccactgcctttttaaactggaatcggttagaatgggttatcaaacttaaggagaattaatatgtcattattaagcgtggcctacctgctgattgcaattatttcagttggtgtgaccatctttgatatcattcaagttcggatacatgcgcaaccaaaagtctggcgtatccttttgtatcttgcggtggcagccttttctctggtgttgaccttgcagcaaagtcaacattttgacgatcttgtcagcggggtctttattgtcgttatgtttatctgttttgcctgctggcagaagggtcttgctgatgctgcgatgattggcgggcttggtagcattcgattgtatcagaatctttctggcgttgttttacaggcaaatgctggggggacgctgctattggcgcaagccggtcaagtgacggttttaaaactgcagtttcgccagtcgccaacagatctacaaagctttttggtcgataaaatgccaccagaacagattcaaatcgtgacagggtgatcagttgggcgttttctgaaaatggtgtataattttttctgatacgattcaaagagctgggatatttctgcatttgcaaagacagaacctgttatgtcctgatttttttcgggttaacacgtttataggaggatgagcatgcaagccaagaaagatgacaagcccgaactagcgcgtcacttgaaaagccgacacgtgcaactgattgcgattggtggaacgattgggacaggcctttttctaggatctggtcaatccatccacaccgctgggccttccatcttactagcttatctcatcacaggtgggatttgttttctaattatgcgggcattgggtgaactgctgatgtccgatgtgaattcacatacgtttattgattttattagccaatatatgggaaaagatgctggttgggtgactggctggacctactggatttgttgggtggcggtcgccatggccgaagtgacagcgatcggtctctacattcgattctggttgccaggagttcctcaatggctgccgggcctgattgcactggcagtgttgctgctaatgaatctggttagcgttgggttgtttggtgaggcggagttctggtttgccttgattaagatcgtggccattattgggttaattgcgctcggcgtctttatgctgtttgtgcactataaaacgcctgttggctatgccagcctaagcaacctcgttaatgacggcggcttttttccaaaaggaatgagcgggtttctaatgtcgctgcaaatggtggtgtttagtttcgtcgggatcgaaatggtcgggttgactgctagtgaaaccaaagatccgcataaagtgattccagaagcgatcaatgagattccgatgcggattttactgttttatattggcgcattgtttgtcattatgtgcatctacccatggcgcgatgtgtcacccgttaatagtccttttgtcgaggtttttcgtaatgtcgggattccagccgccgccgacattattaattttgtggtgttgacagcggcagcatctgcctgcaattcatctattttcagcactggcagattactcttctcactgacattaactggtaaaagcaagtccgcgcgttggactgctaaactgtctcggcgacaagtgccagcgcgggccattatgatttcaacaggagccattgctgtggctgtcattttgaacctttttttaccggagtctgttttcgcactggtttcaagtgttgctacaatcagctttttatttgtttggggcatgattgtcctcgctcacttgcgctataagaaacaacatccgcgcggaacggattttccaatgccattttatccttattcaaattatcttattttggcgtttttagggctgactgctgtgattatgatttttgatcgggcaatgctgtccgcattgatctttgcggttatctggattgcaacattattcaccttgcgccgattgcacgctgatcataaagctcacgaagacaaaacaaaagacggtatttaatctgattgagtgagcactcgcttcaataacggaaaagatacttgaggactcatataaaagtgaaaataattttgagtgaacactcaaaattatttattttagggttgactaactttagcaacgcgttatgctattgatggttcgtagatcaacacgcatccgtcatcatgatggcggtttatagagagaggggccgacaatggcaaaagtcgtgacatatcgccacttgacagacgatgttgttgctgcacctgatcaagaaaccgagatcccggataattatcgctgggagccttcgtggcggttccggatcaaagcaaatttggtttatgcgggttcttggctttttgcccaagggtattgccgcagcgtcttacatgttcgcaatcgcaaggcctttcgccaggctgccggacgcggttattttgtttatggtaatcacacccagccttttggggatgttttcacacccatgcgcgtgaatcagtcgcgccgggtttttacgttggcatcaccggctaatctcagcgtgccaattctaggacgaatcgtgccttatggtggcggtttgctggtgccaagcaagttacatcaattgcgcccgtttgctcaagccattcggcgcgttatcaaacaacgacatgtggtcatgatttatcctgaagcccatgtctggccttactataccggcattcggccgtttgaaaatggtgcttttcattatccggtgacaaccaatgcaccagtatttgcaaccacaatgacttatcaagcccggcggtggcggcaaaagccacgccggatcttgtatgtcgatggccctttttggccagatgaacagttaccgctcaaagcgcgtcagcagcagttagaggcgcaagttcgaacggcgatgactactcgcgccgccttgagtacggcaacgtatattcactatcagcagcgagaggaggcggactcatgacgatgaacatcatgttttgcggtgatgagaagatgacggatggcgttttgattgctaccttgtcattgatgcggcataccgatcaaccattgcatatttatgtgttaaccgccaagctaaacgtcaatggccatgcttaccagccattctctgcggtgacggctgagcgcatggctgacttgatgcggcaggagaatccgcagcaccgcttgacgcggattgacatcactgatttatttatggctaatccgccgcaagcaaacatgaccacgatgtttaccccttattgcatgttgcgtttgtatgctgatttgattcctgagttgccagatcgtgtgttgtatcttgatactgatattgtgtgccgtcgatcgtttagcaacctgtatcaagaaccaatgaaagacgtcgatattgctggtgtattggatcattatggcaaatggtggttccatcataaattaacctggtttgattacattaattccggggttttgctgatgaaccttgctagcattcggcaagatggcttgctggttcgctgtcggcgcctgatccgccatcgttggctgtttatgccagaccaaagtgcactgaacatcattgcaaagtcaaagcagattttgccgcggaagtataatgaacaacataaagtcgaaacggatactgtcttccaacatttcaccacctcattccgtttctggccgcggtttcgtattgtgacggtcaagccatggcaaatcagtgctgttcatcaacaacttggccttcatgaatatgatgatctattaaacgattatcgtcagttggccccaaaattgaaagaagtgtcttaaatgcctcaacaaactacggttcccattttcttttctgtcgatgacggttacgtaccgtgtctggctgttgccttgacatctattcgaacgaataaagatccgcaaactgatttcgttatcaacattcttaacagtggtttacttcaaaagaatcagacgcggcttgcggctttagcagcgccgcattttaccattaactttatcgacatggacgcggtcacgcagcagattagtggcgacacaaataaactgcgcggcgattatgtgacgttgacgatttatttccggctattcattgctgacatgttcccgcaatatgataaagcaatttatattgatgccgatacggttgccgatggtgatttggcagaattgtttacgactgacctaggcgataatttagtcgctggtgttgcagatccggtgatgatgacatacccggaaaccattgaatacattcagcgtgattttggtgttcaaccaggtgaatacatcaattccggggtattgattttgaatctcgcgcagatgcggcaggaacatttctccgaccggtttctgcatttgctaaaaacgtatcattttacaatgattgctgcggatcaagattacatcaatgtgatcgcacagcatcgaatcaagtacctgtcaaaaacttggaatatgcaaacaggtgtcccgactgctgctgaatcaggcggcaagttaattcactacaatctttttggcaagccatggcattaccgcgatgctaagttagcggcaaacttttggcattatgcgccagcatctggttttgaaacggatttgaagcagcagttggcggcatttacgccggctgatcgacaatcggatcgggacagcatggcggcgatgctaaaaaccgccgttcaagtttgccataccgataacacgatcttgaacgcaatcaagcatggtgaacaggtggcgctatgaaatccggcaagtttgttggaccagaccgagccgcggtgatcgaaaatattcgtcgcgcggtggcggctaaggcattcaacgttaaggtggaagaacacgacccgactttctcggaagcacaagaaacagctattattgatcattatttacatcagcggcaacgctggacattccgagtgaaaacttttatttgccgattgctggtgaatgcttatgcagtgagggtcaccagcgatgttgaagttgttggggttgaaaagattcgggcgattaaaagcggtggtgtcatcacgagcaaccactttagtccgtttgaaaatatggcgattcgcaaagctgtccgtttagctggccgccaccggatgtatatcgtgagtcaagacaccaacttggccatgaaggggttgctgggatttgtcatgaattatgacgatacaattccactatccggtcgtccaagttttcttaacggaccatttatgcaaatgctaacgaaggccttttctggacatcattgggtgttaatttacccagagcaagaaatgtggttcaattatcgcaagccgcgtccgcccaagcgcgggtcatatttttatgcggctgaggccggggtgcccattatctcgtgtttcactgagattcgtgatttgaaggcgcgtgaaaatgatcaattacgcgaggtcagttatgtcctgcatgtacttgatccgatctacccggatcgcaacttatccgtcagagacaacagttttcaaatgatgcaacgcgactatgctcaaaagcggcaggcttatgaagctgcttatggcaagccactgacttatgcattcagcgaccaggatatagctggttgggacccgcagtaactagcaaaaaatatttttatttcatttaaaaagaaaatgtgctcggcacttgttggacaatcagtccgccaagtgccgatttttttgagcatgaacggatcgactaaataaccgaggccaaagtgacagtatatgtctcagtgccacttggtatgctgcggcgaatgccaaccgtaaccttcatagtgatcaattgacagtggcgcgcaggtccttcaccaacttgcttgttatgctataacggaagtgagaggttatatttgaaggaggctacgctttgatagatgttataaataatcaagcttttcatcttcacaacgatcaaatcagttatatttgcgctttgctgccgaatggtcagctcgggcatctttattttggtccgcgcttgtcattaactaaaaatgacttagcctatttgtctcagggcccaagtccgtttgcgtggatggccaatttttcagacgaccaggaatttgccttgggtgatgctcagcaagagtatcctgtttacggcactggtgattttcgccaaggcagcctgagtgtgacccaagatgatatgccaatttatccgaactttgtttttaaagatgatcaattgacgcatacgaaaacgcgggacttgcaccatccgacgagtttcggcaatccggcattgaccgatgtgctgacgattcatcttgaagataaaacggcccaattgttgttaacgttgcaatatacgatttttgccgacagtgcggcaattgttcgttccgccacactaaccaatcaaggggcagcaccagtgatgattcaacgcatgctgagtggcgttttgaacttgccgcaaggacggtatgacgttgttcatttatctggtaattgggcgaaggagcgtcatattcaaacgcaaccgttaactcagggaacattttcagttgaatcgctacgtggtgcctccagtcatgaacagaatccttttgtggccttacatgcagcgggacagccgtttgcagcaggcgatacctatggggcgaacttgatttattcgggcaactttctggacagcaccgaggtcaacgaatgggatcagactcgattgctaactggcattcatcccgcatcgtttagttggcggttggatccaaaaaccagttttaccacgccagaaaccgtgtttagttatagctctggtggtcttgccggcttagctcaggccaatcaacgttttgttgcccgccatattattgatccgcaatggcgtcaaaagcagcgcccggtcgtcttaaacagctgggaagcgacttactttgatttgaacgagaagaagttgctcaagttagcggcactcggcaagcaggtcggtgtggactgctttgtgctggatgatggctggttcggaacgcgcgacaatgatttgagttccttgggtgattggtttactaataagcataaatttcccgacggtctcggccattttgctcaggaaattcacgcgatgggcctgcagtttggcctttggtttgaacccgagatggtttcaccgcgatctcaattcttccaagcccatccgaattgggtcgttcgaccaaaaaagggtcgtatctcgatcacgcgtaatcaatatgtgttagacttcagcaacccggctgtcgtcaacaatatttttgaacagatgcaaaaggtcatcactgaaaccaacttggattatgtgaagtgggatcttaatcgcagcattacagaggccttttcaccgtatctcgaaaagatcggtcatccgcaaggcgagttcttccatcgttacgtacaaggcgtgtacacgctctatcagaagctgctgacggcattcccgcatttattgattgaaggttgtgccggcggtggtggacgctttgatctgggcattctgttctacagcccacaaatttggactagtgatgattccgatgcgatcgaacgcctcgccattcaatcaggcacggctttggcctatccactgagctgcatgagcaatcatgtgacagccgtgccgaatgaacaggttggtcgatcaacgccgctggtcacgcggtttcgggtggcggcctttgggattcttggttatgaactggatctgaccaaacttgatgcgcgaacattggctacgatcaaggctcaaattgcctattaccacgccttacaaccgctagtactgaaaggcgactttagcctattgttaccgcgacagtccaatgggcagaatcaggtggcgtggttgctcagcgctcatgatcgcaagcaccttgttcttggctttttcagagtcttggctgatgcagacagtcgcactgtgcagtatatgaaggtgccattggcaaaatctgacacaccgtattgggtcaatcagcacacaggcccaatttcgggggatgtcctccagcgcgttggtgtgcgcttaccagtccaattcaatggtgccaatcgcgcacaggctcagttaatcggtgactatcaatcggcactgttgacctttgatagtgtggcaagtttggatcacagtgaaagccagcagaccgatgccgacaagcaaacagttgcccattaaatgtgctgccaaacagctttggtttgacaatggctgttcagatcaggaatatgagtaaaaaaagcccgataaacgagttgcaagtatcagttcttgacttgcagctcatctatcggacttgtttgtccctttttagtcacgatgcttgcttactagcaaaataccagtaaccaagctcatggtaccggcaacgatgccaacagcaccagcgacaagtgtcacaacaccaacagatcgagaaaaaattttgctcaagagattatcacctttctattgtttggcaggatcgtaactaacaacaatgcatgaatcttgattaggattctcaatccgttcatcgttcgattcattgttcaataaatctggttcatcgctatgacgaaagcgcgcagtaaaaacagtttcgtcattaatccgtttaatgtaacgcgcagctgcgccggggctgaccaattgaatggacgttgatttgccatcgttaacggcgtcattcagttcggcaacagtacctgctagatcgtcgtgcgaaaacccagcagattctaaaatgctgagaagtgcttttactttgtcgttcatgattttcctcctacttgtcattttcagactcacggcactattgtagcaaatatttacttacggaaggtaagcttttgtctgctaggtgacgacaaggacacattttccaaacaacccaaaataaaaagccccaaaacgctgatttaccagcattttaggactaactagaagtaagggaaaatgtcataatggaggtgaggagtctccaactacattagccttaaccgctgatacaacagcatttgtgcggtggccttactccaaatgttacctaaaatgttacctgtgccatatattctgctaacttgtcgatgccttctcgagcatccgactgattcatgccagcatatatgcgaagcgtcacatcgggcgtagagtgaccggcaagccgctgtacagttgaaacatcaacaccgctgcggatcatattcgttacaaaagacttacgcagaccgtgcaatgtgatgcgaggtgtaaggtggtttgcttcaataatatctttcagccacttgttaggcctgttaatgcctaaacgtttttcaaaatgttgtggagatgggaacagtggccgatcatctcgaatgctgataattttgcttgtgtcaagtaatgctatccactttttaagctgtattgtcactttcggggttaatggtattgtgcgcatacccgcggttgacttggtacctttaattgattccttaccattcagaccagttgcataggctttattgattgacagtgtggacgttttgaaattaacatctgatacgttcaaagcgcatagttcttcacgcctgataccggtgctaaccatcagcagaaacattgtgtacttttctggatcgttattaggatcaatgcaagttaggaatcgggcgacttgcttgttatcccagtaaactggtgactttccagatcctaccccgcgtggcaattcgacaccgtctgcggggttcttttcgatgtactgcatcttaacagcaaatgagagtatcttcttcaaataaatgaaacgttccttgtatgctttggtggttgtttctcgccactgactgacagcactttgaatgctgccggtttttatcgcggtgagagttttagaaccaaacatagggatcagatggttatggaaaagctgcttagtcttataggctgtacttccttccacagtttgaacatagattggccaccactgattatacaaatcactaaaggtctgaaccggtggggtagtgtcttcttcatcatataaaccattggccacgtctagcttgagttttgactctagtagacgtgctttttgcatgctttgaacattgcgaacaatattcttgcgttttccagcaacaaggccagcgttgactgttacgcggtagcgaactgcaccagacttaagctttacttttttaattgccatattcttctcctatccgtcacgctgggcaggcggtgttagattggagagttttcgccggaattggcgaaaaggtggcggccgatttttcggccatgatattagatatagaaattaagcgtgttttgctgttactgcatctagaagctgttcaaaagaactcatgaattcagacttgacgtagtcgacttgcccatcgttcttaacgattgaacgtaatccacttaacaaagcaccaaatgatgccgacagacccctatctgaatgaaaaccattgtagaaagcaatacagagctgaattgcatcattgatggtcaacatctcaaaagtatccatcttttctaaatcgaggttgtcaatactattaactaactgattcatggcgcgctggcgcatttgattcacggattcagtggtgctcatggactttttgatagcagataatactttttctgcatcttctggagttttatttccatgttcaaagtcatcaataattttttttagttctcgattagtcatcgtatgtgcgatggtttcatcaattgcggttggatcactcgatatcccttgtagatatggtattgaaactcctaaaacattcgacaatttttgccaagtgtcgattttgggctctcggctattgttctcataaaggcttattgattgacgtgtaaccccgatccttttagctagatcagcttgagataagcctttgtcttttctggctttcaaaatgttattttgcatctaattgccacctctcttcctcgttatcataaatttttttgcacaaagttgcaactaattgttgacagcaacataatgttgccgtaggctatagatatcaaagcaacaacttgttgccgtggaggtgaaatgatatggcttcaatgaaagcagaactattgttgtccgaggaattcgacaagcagctacaagatcgtattcatcaggaagtgatccaagcggtcagtaagcttgcaccacaacatgatgagcctaaaaagctgaacatcggtcaagcagcggtttatgccggtgtggctcgtaacacactgttgtcttggactagaaaaggtttgccgatgcaagtggttggtggcgttaagcgaatcaataccgtagacatcgacaactacatgaagaacaacggcaaataatcacgctgggcaggcggtaaattgtaagcaacttatggcagacgcataaagtcagaaaggaaacattatgaatttgtttagtaaagaagagatagcactagatcacgagcttggaaatttgattgacgacattcagcttaacgttcatggcattgcagaagacagtactgtcacggttgatggcaagtatattcccaatagcgagttggccgttacgactgcaaaagagctgctgcgtgtatcggaaatcctaaagctgtatgaaaacgaggacgatgccgattactagccttattacgtggatatttatccacccgacagttatacccgtcatgctgatggttttcatgaacggtggcgtgctgggagcgtttctacagtttagagaggactatgaccatggcaaaaatgataaatagcaagtatgggtggacgtggtcacagtttgtaaaggctgacgctgattgtgatcggtattgggcagctaaaaaagccgaaaaacgctcactaattgaggccacaaaaaaatcgccaagagcggcaactcaaggcgagaagaagacaagcgaaaaaatctatatcgacttttagcttgcctctaagtggttactttgtcaaggaaaatggaggcaattatgatgaaaaatgtttcaactactgttaataaaccattagatttgtgtgattcgctgtacgacttgcgcaaagcaaaaggggcactatctgcactatgcgatgaactagatgagttcggtatctcagtttgccatttcgataaaaatcactcgcacgacaatgccaaattggtagctttagaggctttacgagactttgatacgtggaaatgtctagtcttttgtgcccgagatattatcaccgaccagattaacgctattgactcccctgaaactgatgaggcagacaaatgatgacgaggccagatatagaagcaactcaagatttactcaaagaagccagttcactgctaatcgttctgcggcgagaacttaaagataagtcacttgaagcattaactgatgccacatccgacaagatcattgatgctcgccgtctacttttggaaggagatgttgccgatggtcgacgtgcttaaagtagcgcttggttatcagcagcatggctttgcagtctatccacttgcgccagagacacgaacaccacttgctggttcgcatgggtacaaagatgccaccaaagacccagaacaagccaagaaatggtggggcgaacatcctaactacaatattggcttggggcttgatggcgtgctggtattcgatattgatatgggtcataaaagcggggctaatggcaatgagacgttggctaaattgtgcgctgatggtcgtgctggtcagattccatctacctatatagaaacaacgccaaacggtggactccatatcttcttcacctatcccaaggaattgaagctaaccagtcgatcggatttgttctctaagaatggcgaaaaaaccggcctcgactatgtcgcgactggtgtaccggttttccctagcattcgcgagaacggtatgtatcaaccactcaaaggacacaagatcaccaagctagccccagcgcctcagtggttacttactgagattcaacgtgtcagccaccctaacccacagttgggtggttcaacagtttatcgaggtaaacgatggacaggcaagctactagatgaaatagtgaacggcactagtactggcaatcgcaatgactttctgaccaagattgctggcaaaatgttcttcacaggtgcagagccgcagacagtttataacttgctgtttacaactaatgataactatctagatacacccctggcagaagccgaagttaataagattttcaagtcagtattgaaagccgaagagaggaggcgtgcggttggttaaagcgatgcccgaagatattaagcaagaagccaataaagtggtcaacgttgattttacaggccaagagcaatggcgcaatgaccttaaacttgacggcaatggtggcattagaaaagactcagtcgttaatgttcaactgctgcttgataatgatccaaccttcgccaatgtgattgcatgggacgatttttcagagatgcttatcaagtcaaaaggcgttaaaggattaccaatccgcaaaggattctggaccgatgaagacgatgctatcgtccgctcatacattgaacgcaagcacaatatattgttcagtaagcaaaacgaacaagacgcgatggtcaacattggcaaagagcagtcgatcaacccggttaaagactggatcgaaacggaacaatgggacggtacacccagagcagaacgttacttcatcgactatctaggtgccgaggacaatgaatatacccgtgctgttactcgtaaatggttagctggtgctgtaaaacgtgtctatcaacccggttgcaagtttgaactcgttccaattcttgaaggtaaacaaggacttggtaaaagtacggctgctcgtaacttattcccgacaaagttcagcgattcattaaaatcaatgggcaaaacggacgaagattacaagaagctgcaaggtaactggatcatggaactcggtgaactttctgcaatgaaaaaaactgagattgagtcggctaagagtttcattagcgcccagtctgattcataccgagggagttatagccattacgtttacccacatttacgcaagtgtgtgttcattggcagcactaatcaacaggactacttgaaagacgctactggtgaacggcgtttcttccctatcagatgtggtgttacaaagcccacaaagaccgtatggcgcaacgaagaaagcgtaccgaagattgaccacgacgttcatcaggtactggcagaggtcaaaacatgggttgatgcgggtgagagtgtctttgctgatgataagctgatgcaactggctaaaccatatcaacaagaagcagagaccgttgaccctatgaaagaggccatcgaagactttctcaacatgaaagtgccatcaaattgggaaaagctgtcattgagcctgaaggccagcttctttcacactcatattgaccataacggtgatgtggccacttggttacaacagcacttggatgctggagaattacaaccactgcaacaaaccaccactagagagatcatggaagtggtgttcgacaaatcagttgaccgttacctgatgggccgtactggatcggaagcaaaacgtatcaagctcatcatggataacatggatgggtgggatcgtgaacgagtgcgaatcaatggtcagcgttcaagaggatacgtcaggaagtaaagtgtttgtttttctactgtcccacctgtcccagtgctataaacgcctatgtatcaacgttttgttgggacaaagtacatgtcccactgctgtcccaacatgtcccactgctgtcccaacatgtcccactgctgtcccacaacctcatcgggacacgtccgggacagctcgggacacgtctgttgtcccagataaacgcctatataccaacgtttaggagcccgggacacgtgggacacttaaaaaacaaacaagtttaaaactacggaggttgaaaacaatgctatatccagaaagcacatgggctaggtttgaacaagaattccctatccctcagaagtatcgcaaatattacgagtacaagaattggcacattgaacctaagtcgcccggccttagcccatttgaacaggatcatccgttcgcgtttatgctgatgcccgaggacatgcagaacgctttatatctttggactaagggactggccaagcgaaagacaatcaacagtgagtacacatcgtatggcattaaacatctgttcactgatttgccgggtggtttctacattactaacggcatgatgaaaggcgcactcttagcagcaggatttgagattgctgactatagagagcttaactggcatgccaacatttcggggcgaagcattaaagaacagatcaagctcgcgccccacatcagctaacaaggaggaatagcatgaagaactattcaattgcccgcctgaacaaggtggctgaaatcggtaagacagttaatcacaggactggtgcaggtattaacatctctacatttgagtcgactggcaccctgttctatggatcatataaccgcactgttacacagacctaccagatcacgggcacagatctagcggacactatatcgatcgtagtgcgccacactgacgcgatagatgacagcacacaggtaaaacttaatggcaccctgtacgcgattcagtctattgcctacgatgatgatcccaatgcattcgatgttgtgacactcaagaagacaaccaaaggagcttagaactatgaaactatttgaatatactgcgtatcaaggagaactaaacggtgtcatcgacaagttcatgatgttacacagacatcaagttgagtttattcgggtatccgttacaccgaataaccttctgactgttcagctttactatagcgacgataagtctgagcctgaaacggtaggcgtattggcatgatcatgaagctatgtaaccacgctgggtgcaacaccatggtgccgttcaatcaacggtactgtgataagcaccagccagaaccacgagcgtccgacaacgaacgctacgcatatcgcaaagcaatcggtggtcgttacttcaagttctacaagtccaaagcgtggcgcaagctgtcttactcgtatcgtctagcacatccactgtgcgagcgatgccaagcaaaggggttatatgtacaagctgacgtggtagatcatattgtgccgatacgtgtggactggagccgcagactggacgagagcaacttacaaagtctgtgtaatgcttgccacggaaccaaaacgaaagtagaagacgcggcacgctacccccacatgaatatgggggctaggtaatctagttttgggaaccaagcataggagtttcgttgttgaaaatccgtgataaccgtaatatattatgtaaactagaaacaatgtgttataattaagttagataagtctaatcgtaattataaagaaaggacgtgatcaagatgggagcaccactgaaatctattacgcaaatgcgcggcacgatgagcaagaagaagctcgccgatcggcgtgacatggaagaatccctgttcacctatcaagaattagttgaccagccccccgcatggcttgatgactatgccgtgaccgagtggcaacgtattgtgccgttactcaagaaggacattccagtgagcgaactggacgctgccctgattgccagtcattgccaagcctattctgacattcagaaagctgccgagctgattcaagaacaaggcatgatggttgaaaccaccgatagtgtgaaagctaacccagcagtaaaaatgaaacttgatgccactaatcagatgatccgtattgatgacttgcttggcttgtcagtctacagccgggcaaagttggcagtgaagaatgagactaagaagaagccttacgatccgttcgcggatctgatgtcatcatgaactatgcggctgaatacactgacaaggtgctaagcggtgagattgttgcttgtaaaaagatcaagcaagctgcaagacgttatcggcgggacctgaaagccagcaagcgcaagaagaacccatggccgtattacttcgatgaggactttgccaacaaagccattaaattcatcgaactgatgccggcacgtgatgggtcaccgctaaaattagaactttaccaaaagtggttggttgctgagcttttcgggtggagagataaggcaaccggcaatcgccgttatgatcgagcctatatatcgatggctagaaagaacggaaaatcgtacctaatggcctgccttggcgcgctgtatctcctcagggagaacaagccagccatgaaccgagagtgtgtctacacagccaacagcaattcccaagcacatttagcctttgatatgttgtctagtggtttgcgtcaggtctctaaggtgtctgagtcagtgcgtgatcgtttgaagatcaaccgtaatgaaatcatcgacttgcagagcaacagccgagccgttccgcttgcgtctgatctgcacagcctagatggttatcaaagtgacttggctattattgatgagttcgccttggctcgtaatgatgagattctacgaacactcaaatccggccagatcaacagtgaaaacagtttgctggccgtcatctcgaccacgggaccagacctgaatggtcctatgtataaagaatataaattcgtttccaaagtcctaaccggtcgcgaacaagcagatcggtattttattgccgtttttgagcaggatagcaaggatgaagcctttgcaccagagacttgggagaagtccaatccactactggctaatgctgaaagagcgaagacaatgcggcctagcttgcaagctgatgttgatctagcagccaagcaaggaaccctaaggccagttctcgtcaagaactttaacacttggcaatcagccagagcagacagttacatcagtctggacgactgggaaaaagccactaccgagcaaccagacaccaaaggaaaagacgtgtatatcgggctggacctatccaagtctagcgacctgactagcatttcgtggctggttccagaagatggctacctgtatgctgacagccattcattcgtaggaacgaagtacgggctggaagaaaagatcaaacgtgacgggttcgattacatcgctggagaacagcgcggcgagtgcagcatcaccaaactggagagcggcatgatcgactatgacgaggtgctccgcttcattctcgacctgatcgagcggaaccagtggaacgttcgtgccatctgttacgatccatggtctttttcataccttctaccagagtttgaaaagcgtgacttgccaatggttgaagtgcgccaaggtaggcttacgttgtcgattccgaccgttagattccgtgatgatctcttcaatggcaagttaaagcaccctgataatcagttactggcctatgcggtgaacaacgctattctgaaatacgattccaacaataatgcactgatagataaggcaaagaacgccactaagattgatccactggcagcactgatgaatgcctacacgattgcaatgaattcaatcacgacaacagaaaacagtgaggagatgaaccggttctatgcgagcgatgactttggtttttaatgtgcagaccgtgctattactgctggggctgatctgtatggttgtcggtatctggtggctgttcgggtttggcgttggtatgttagcagtcggcacggccttgatctccgtcgcagtcatcatcaacttcaacaaagggaggtgaaacaatgagctttttcacgaatgacacaacaaaaccacgcgatgacaacagcgacccgttcttagatgcgcttgtcagcatgaccaccaatgacagcggcttatatgtgggaattggtgcgttacgtaattcggatgtgtttacggccgtgcgcgtgattgccagtgatcttgccactaatccgattgaatatagtgacaagcgcatcagcgtgctccttaacaaagcacccaatgaccacatgaccgcgtgggcgttcaagtttgctctagctgctaacatgctgctgaatggtaacagctttgcacgggttactaaaaatcctagcggacaagtcactggcttcgagttagtccccaacagtcaaatggtggttaaacaagatgatacgaccggcattatcagttacgaatacacgcctgacagcggtcgttcacagcgtttaaatgccagtgaggtcttacacttcaagtgcttcacacaagacggttacaaaggactatcaccactgtatagcctccgtgatgaggttggggtacaaaagtctggacatgcgttactgaaaggcttctttaacaccggtgtccaagggacaggcattcttaaagtcaacaagacccagctagacaccaaggccaaagaaaacatccgtcataaatttgaagctgccaacagtggtgataatgccctcaagaccatcattctagataatgatatggattacaagcaactcgaagttaatactgacgtgctgaatctagtcaattctagcgattggacaacgaaacagattgctaaagcgttcgggttaccattggatcggctgggtatcgaaagcgagcactctaatgccgtacagtcaaatttggtttatctgcaaaacacactgattcagtattttacctgcttcacaagtgagatggatgctaaactttcgactggcgataatcgattcagcttcaacactgacaagctgttcagtgcagacccagcaacgatgcaagaactagcagttaaggggctgcaaggcggtgttctgaccactaatgaagcacgagcaagattaaacctgtcaccaattaccggtggtgatgagatcatggccagcctgaactatacgccgctaagcaaccttgtcacttatcaagataaacagaaaggaagtgcgtcaaatgaacaatgatgacgtagaaaagcgcctgaatcctgacgctgatctaactgccgctgatcctaccacagcagacgacagtcaagaccaagacaatccagacacacagcaacaggacgacaccactagcgggccaaagaaactaagtggttatgcagtagttttcaatagcccaagtaaggatctcggtggttttaaagaagtcgttgatccgcacgcattcgacaatgtggatctatcagacgtctatatggtttcaaaccatgattttagccaagtcttagccagtaccaaggctggcaccttgagtctaaatgtcgatgataaaggcttgcagtttgaagcaaccttacccgatacgaccacagccaatgatgcttataacaacgtccaagctggtaatctgtcagccatgagttttactttcaatgctgcgccagacggtgacacgttcactaaggacgacagcgggcaagtgattcgtaccatcacgcaagtaaagagtctattcgacgtctcactggtagctattccagcgtatgacgataccaacgtccaagtggacaaacgcagctacactgagtggatgaaaactaatattgaacaaccagaaaaaggagataaaaccatgaccgaaaaaacaattatcgacaacaaagaacataccgaatctcgcgcttacgaagactacatccgcagcatgggtgagcaacgagacggtttaacgacaaccactgctggtgcagtcgttcctaaagaagtcatcgaagacgtctggaatctaaaggaatccgattatgacctggctaaatacgtcactgtgaagcaggtcgggaccccagttggcacctatccgatcgcccttaccaacaatggcgttttagccaccaaggcagaacttgcagacgtgccagagatcgatgcaaccctattccgtggtgttgactataaggttgctacccgtgctggcaagatctatctgtctaatgaactggtagaagacagtgaagttgatattgttgccgaggttaaaaatcaactcaagaagctggtacaaaacacggacaatagcaacattatcagcgttctgactggcaagacgggcaccaacgataacttcaagcacatcactggcactggtctcgatgacctcaagcaaactttcaatgttgagttagatccagcactgtccttgtctgttatcgtcaatcaggacgcttttaactaccttgataccctgaaagacagcgaaggccgatacttgttacaaccttcaatcacggcaccatcaggcaagcaactgttcggggcaccagtgatcgtgattgctaacaaagtattgccgactgataaggcgggcacctatcggatcatcatcggagactttgctcaagcaatcttcttagcccaaaagaacgaagtcaacactcaatgggaacggttcgacagttatagccaaggtttggcggttgtcatccgcaacgattacgaagtggttgatccagacgctgctcgaattgttgatatcacaccggtagcagccacgccaaaagcataatttagtgggggtgtgccttagggtacgcccctatttttataaggagatgagcacatgactgtaactactaatgacattaaaaatagcctgcgtgtgcaaactaatactgatgatagtttgatcagcaactacctgacagcggcgcaagactatgttcacaatgccgttgacagcacagcggcaattgatgagttacaagcatactcgcagtttgatattgccgtggccatgttgaccgaattctggtatcagaatcgtggagcagttaccacagcaagccaagagccaccttattcagtggttagcatgatccagcagttaagaggactgtttacggaaaacgtatagtatcaatagccaaaagattatgatataattaaggcagtcctaggcgataagcgggtagatccgttttaaccgacgcacggcatagctaaccggtggcgcattttatagaccaggttactttttgcctcgctgaaatccaggcagtacagtatcatcattacactaacctctttggtcataaaaatagccagtttcttgtttagcagatcgttctgcttgggaaactgattacatgacttgtcgttttcaattggcgggcagagatgcccgttttttgtgtgctgaaaaagttttaagcggctcaaacccacttttaatacggcgctgacagacgcgttctgacacaatttcaacgactgttccttgaggtacggtcgtggctgaactagacaacgaatatcagaaccagttactggcacaaaaatagccacctcataatgaagtggctattttgtgttagtcatgtagcttttcttgtagtttatctccagcattatcaatgcccttagctgcgaagactgtacctgcaactaaaacaccgccaacgatgagagtactagcaaccataaacttaaatgcagcttttaaagcgtccataaagatggcctcctatcagtcttttgatctgccaacaaagaaggagactacggcaacaacaataattgcgccgataattgaaggaatcaaagccattcctgccagttgtggcccccaatggcctaaaagtccctcaccaattgcagaacccactaatcctgcaatgatgttagcaaaccagcccatcgatttgcccttgctagtgatagcaccagcaattgcaccaataatagcaccaacaattaaagcccaaagaaaatgcatgataattcctcctttttggttatattgtctctatagacgaacacagtataacatacagtagcaacaagagataataaaatagccgcccataatggacggccaccgcctgccaagcagattaaaatgttacctaaatgttacctgatgttaccaactaatgataatcagtgactatctgccaaacataaaatgctgctacaccggcattttcaacaccgatgaaagctaatgataatgataagtggaggtgaggagaatcgaactcctgtccatcacccctgctacatgcagctctacacctatagctgacttatttaaaattcgccgcgatgtcgcgccagccagcaaggctaacacaaggcggctaacctactagtctcttgttaatgcctcaggtggcaacattaaccgtagctcaataatttgagacccagacccgacccttgagcgaagtcggaaggatcacgctagctggttattaagcagctaaagcgtaagaattttcgttctttgcagttatattaactgttccgttgatgacggagccgagcctccgaggtgcactgcatgtgcgaaaagcaatgtcgagaccattacacccccgattaaggtgcaaactttatgataccacggtataattaagcttgtcaaaatgtttggttttagactggcatcaatttcggatttaagctatttttatggaggcatgtctatgattctacttattgccggatgcatgcaattactgatgggcatccttcttgctgtttttcgaccgcgtcatcaatctggtttctggggctacacgtcctatcttgccggggtgaatgccgaaagttttcgcttggcacaacgttggttttgccaagcattgatcatcacaggcgcacttgaagccggtgcgggctggttgatccattttctggcatgggacgatttctttattgtttggctatttttggccgtcatgttgtttctgccaggatttgtctataccgagacgcggttaaagcattatttgcaagcccatgatgcactgccttatgactacgtgtcaccagacgatgcaccgaaaccgcaacgcaaaaaaggctttaaagatctgtgaaatgaggggtacatcatgaaattattaatgatcgaagataacacgagtgtcgccgaaatgatggcgatgttctttcaaaaagagaaatgggaagtcgtcaacgcctatgatggtgaagaaggtcttgctaagtttaaggaagcaccggacagctttgatattattacgcttgacctcaatctgccaaaaatggacggcatgcaggtcgcaaaagaaattcgtaaaatcagtcaaactgtgccgttgattatgctcacagcgcgcgatactgaaagtgatcaggtgttgggactggaacttggtgccgacgactatgttaccaagccattttcaccgattacgttgattgcacgtatcaaggctctacatcgtcgggctgaggtaggcgccgaagtgggtgctgagcagacaacaagcgagccgcctgacggttttgatgttgaaaccgatcacttcaagctcagtaccaaaacacgtgaagcttatttggatggtaagcaaattgaaggcttaacaccaaaggaatttgatttactgcataccttgtcgaaaagtccgaagcaggttttctcacgtgaacaattactgcaattggtttgggattatgagtattacggtgacgaacgaactgtagatgcccatattaaaaaactacgccaaaaagtcgaaaaagtcggtccgcaaattattcaaactgtttggggcgtcggctacaagtttgatgattcggggcttgatcgatgaaaatgctctaccagcaactgattggctttttctcagtcattatggtgaccttagtgattgtctcgattctgtttattcggtctaccacgaacacggtttgggaaaatggctttaaacagttagagcaatacacggatgttttaaaaaataatgcggttgatgaaaatacttacgtcatcaatgccagatttattcaaaatgctgaagagattttaagcgatcaacacgtgcattttgttatttatgatgccaataacgttgctaaatatcctgtgtcccaaaaaggtcagatgccagcgatcaaggcaagctattggaaaaagctaaagcaaggggcggctgttgccgtcccggagatgatgacgaatccaatcagcggccatgcacaaagcatgacgatctattatcaaccggtttttctgagtgaaaaattactctttgtgattgccgcctttgcgccagttgagcaaattcaaagttcaattagcaaaactgagcataatttgcttatcgcgttcgtactgtcaacgcttgcggcgttcatcatcagttatttcattgcgtcctatcaggtgcggcggattaatcaattacggcgcgcaacgcatcaagtggcagaaggcaattatgatgttgaagtaaaaattaaaagccgcagtcatgatgaagttgcggaactggccgatgattttcgcgacatggtgacctcactgaaagctagtcagcaagaaattcaacggcaggaagatcggcgccggcagtttatggctgatgcggctcatgaaatgcggaccccgctgacaacaatcaatggcttacttgaaggcttggcgtatgatgccatccctgaagaaagtaagggaaagagtatcgaattaatgcggaacgaaacgaaccgcttgattcggcttgtcaacgagaaccttgattatgaaaaaattcggacaaatcaaattttgctcagcaaacagacgtttaacgcgcgcacggaccttgataacatcgcggaacagctggcgcagaaatccgaagaggctggtgataagatcacaattgatgccccagcagatctgccgacatatgctgatcatgatcggttcgttcagattcttttcaacattgtccaaaatgcggtccaattcactaaaaatggtcaaatcaccataaaagcaaaagtggggtatcaccagactgaatttgccattagcgatactggtattggtatgtccaaggatcagatgaagaatatttgggagcggtattacaaggccgatccatcacgtaaaaacaccaaatatggtgagtccggtttgggcatggcgattgtgcatcagttaatgggacaacacggtggcaccattcatgttgattcgaccctaggcaaaggtacaacctttacgttgaccttcccagatgaagcgacagcgcctaagcaaaagcagccaggagccgatcagcagacctcatcatgaagaagagacaagttcaagcagcgtcaagatacaccagaaaaaggccattaggaccgttcgaaatgatcatcacgctcacgtggattgcctgattttgttaagcaaaagttttgccgcgtgtgatggctggcagggcttttacaatgcagtagctgcttagccaaaattatataacaattttggctactgggttgcgtccaaatcctcacaacgacggctttgcatggaaacgtgtataatagaattaataaactaaaaggagacgcatatgaccattcgacgaatacaacaaaatgattttgctgatgtagatgccttgttacatgcagcattcaatgccagcaatcgcggttataacggtgaggcagagctagttgccggactgcggcgtgatcctaattatgattcagcccttgaagttgtggcgatgatggacggtcatttggtcggctacgggctaatgaccgcggccagcattacgccagatgcccatatgcaaggggtggcgctggcaccgttagcagttgccccagaatatcaaggcggtggcattgggggcgcgattgtgactgaactcgacatgcgagcaactgatttgcggcgtgattttgtcagtgttgtcggcgatcgacaattctttggccgacttggctttcaaaaagcagccaagtacaaactcgatccgcctttcccagtcgtcactgaagaccatttgattaaggaacttgtgcctggtgttttggcaagtgttcgcggcaaggtcaattatccagcaccttttttgacccagatagcgaattaatcattgagaccaccacattaaaaaatgagccgcgttgtttaaaacgcgactcattttttaattatttttgtttttcctgatccttgtcgtgatgatgagccatgcggattgacccaatacacagaccgccagtgactaaagcacttcccatgagtgtattgtcgctaacatgcggccagcattcaatgaagacgacaaagccaatgatgaccgcgactaccacaaaatgccatgagaaatgatgtggatgatatgtatgctgtaccttcatgtgaaggcccccttataaatgcgttcgcaggcgcagaaacctgtccataaacatttgaaacccaactggtcaaagatccattcatttaagcttcaagtcacggatgttcaggtttctaaacgtgtccgcgcacgctttgtatgaattaactaatactccccgcaacgacagtcttagcctaccgcaaaaacgatcaagattaaaggcacttcacttaaacgctttcaggctcatcaaaatgtcatcatccatctggtcaaaaacgctgctatttttttaaaaggccgtaaaaacggtctttttgcttgactttttttattgcaaaccttttacaagttgacagtgggtttgcagaaatgacaatcactgttacaatatgaacatatctgaacgaatgtctattattcaaggacatttagttttagtcaatcgttttggaggttttagcgtgaagcagttttatattgttgacagttcgatgcttccggaagtcgtcggtaaagtcatagcggcgcgcgcacttctccaaaatggcgaggttaagcaggtgagcgaggccgtcaaacaggtcggcatttcccgtggaacctattataaatacaaagattatgtttttttacccgacccagaaatggcatcgcgtaaagcggtcatctcgttgatgttgcatcacgatcgcggcattttatcagaagttctgacaaccatgtcgcaagcgcaagctagtatcgtgaccatcaaccaaaatattccgatccataattgggctagtgttgtgatgtcatttgatatttcggcactgcagggaacgttagatgatcttgtaaccaaacttggcgacattcgcggtgtcagtgatgtgcatctggtttctgttgaatgagcgccatgattatttggaggctgtatgaaaatagcatttaaactattactctgggtcttagtgaccggtgtgattttatttcccgcgctactgttgattttgtttgtcattgggttgagcgtggtcgtttctggtgccatggcaattagcgctgttgggctggtactcggtatcatttttgtggccttggtgggtctcagtatcatgattccatgcttattgctggtgattcgctttatgactttccgaacagtgaatgttcgttttcaacatcatggtgaacgggtggtattgccggtgacggtcaagttgacaggacggacgatttaccacgcgatttatgaaaatttccgtgcgggtcgacggcgcgggcggcatcttttatcagcctgggggtttggatttgagacttacttccacgaagacttgcaggcgtatcttgctgatcagattcttgctcagcacggccctgaaatggcggagtcctttgtggttgatgagcggcattcctactcaattgcgtattaacaaaatgaatttaaaataccatccgcaagagtgctgtgccagcgctcttttttcttggctactttttgaaattgacgcgtttattcatcacgccgcggccgccattgaatcacccgatttgattcaggccagcgcatctcttcaaagccgacatattcaatcgtgagttgcgtgtgctgacgaagcaggccaatgaaggtttctaagtctgccagatcatagttgatcaggctgtgtaagggaatggaacgttggcgctgatccttaggctgaacgttcatgaaaaaattgtatgccggtgtataggtttgattgaccagtgatagccagtaacgtgtttgacggcgtcgtttgaaaaggggggttaatcgcgccatcattagcttcaaatctttagtcatagctattgccgccattatgtcctcctactagtgatgcccgttgaatcgccgttccgccatgcatcgcacttttagcgtagatcaagcccttaaagccaaaacgatcgcgaatagtatctagcgtgcgttctaaattggttgctttaatttgttgatcaaccggctcaaagaaattgagttgttcgccggtatctggggctaagcggccggtataaacggcaacgttacgaatgacctcaccatgccagttttgccgaaaaatcagttgcagtgtggcaacaagatcgccgtcccgattcgtcggtaaaattcgcttagtttggtgaaacccgccgcgtccgtctttttcactttcagcataggaaaagccgatacctagggaaatttcaccagctcgtttgtgatgatgccgcaaccgtgcggcaacctgttcgccgatttctttaataacgatttcgatttcaacttgattgctataatcgcgcggcagaacctgtgagttgccaatgcttggttcgcgggtgatgacgcgttcgctgatttttgtgcggtcaatgccccatgctagcgcaaataactgcgtgccaatgatgcccagttcttgctttaaggcatacggatttgcgtgagcaagttgtttcattgtcgtaatgcccatacgtgcgagatgcgctgctgttcgttgaccgatactccaaacgtctgtcatattggtgatctgccaaatggtatctggtacagtttgataggagatttgaccaattaaattaggatcatgttttgcataaacatccagcgcaattttggcttgaagcggattttcaccgatcccgactgttgtgtagagaccaagtcgatgccgaatagtatgttgaattaattgcgcaactgcacgtggtgttttgccaaagagtcgccatgtgtgcgttaaatcgagaatggattcatcaatggaataaggccacaagtcttcattggcaacaaactcacgaaaaatatcattgatggccagattctttttgatgtaaagattcatgcgtggcggcaccacgatcagatgcttatccacaggtaagtcccgttgacggctaacgttacttttaaggccatatatttttttggccattggcgaagttgccaagatgaggccgccatttgtattctcttgttcggacatgaccacgagaagggttcttaaagggttcagcccgcgttcaatgctttcaaccgaagcgtaaaaggatttattgtcaatcaggaaaaccgttcgatgcggttcgtgggaataatcgtaggccatcaaaatcacctctgcaattattatacgaacatacgtttgtataagcaagcataacgtgatttcagcccagaaaaaaaccgctgcgtcaaaaaacgcaacggtttgattgaatcgacgttaagcaattgtttcggttagcgcatgcaaccgccgatatgactgccccatgaagagacgttggacatcatattgctgtggaagaagcccattcccatgccactgaaggcctctaggacaaagaaggctgcaaaaattgccgcgatcacgatcaaggtgaccatcaatggccgccatttttcagaatgtaacatagcaacgacctcctaacaactaaaaacacatgacagcatgtagtataacaccgttagatgaaggaattgggagaaaataaggcggcacgcaccagtcttatttctgaacaaaggggtgttcacctcagtcaagcattagtctcgatcccacttaatcttcagattagtttcaatcaaatcaccatcgtccaatgcgaaaggttcgacgacactgctgccatcatctttggtgaacttgatattcaagatgttgccatcgcgataaacaacttcccacttaccatttgttggcgtgccattgctggtcgccgtataagtaccgtcactgttgaagttgaaagtggcagtgtcgcctgattcccagcgaccgacgacgccatccgttgaatgattatcattgcgctttgaagcatcagaaggatactggcggttcgttttggtcacaccattgtcatcataatcatcatcgtcgtcatcatcatgagattcagatgttgaagaaccgcttgtggcgtcatgcgttggtgtaactgtcttagcagcggttgcggcatccaaggtcagtgcttccggttgccctttaagcgggacgatgacttcacgattgaagtctttcgtacttccttcgtgcgtaccgctcagcttgagggcgtacagaccaggtaattgactggcgatggtataactgccagaacgattttcaggttgaatttgattgccatccatggtgaaagcagcggcgtcaaggttggttttgactgtgacgttggcggtaccaagcttaaccttgtatttcgggaaaagtagcaggtaactgccttgtttgacgacctgaaccatgccattggtttgcttgtccatgatcatggttcgcaaggtgctgcgataaagccgattcttagtcaaacgggcgagcggcttaagatcactttcagtcaatggtgtgccatcgtttgcaatggcaacttcagccatgtcatcggcatctccactagtcatttcatcagccaactcagcgacttgtcgattttgaccatagtacattgatccgccgagataagccgcacctaaaagaacgacaaccgcaccaacaacgatccatggccagcgccggcgtttatgtacttgttgctgcgctggctgggttgaagcagcaactgtcgcagactgagttgcttttggtgcctcggtaggagacgtcgatgctggttcttgggttgattgggcttcaagtcgggctttccgcaaatcaaacccgcagttaggacaaaagtcgtcagttggtttaattggttgaccgcagttgggacaaaattttaaaacatcttgcataagttattcctccaaagttttcttgagcaaggcagcaatctgatcatgaccgtgctggttggggtgaaaagtatcgcgcggaccgttaccagcgaagtcggtgatggctgtaccggcagggcctgtgacgtcatcatggttttgccagatggtcgccagatcggcaactggaacgtgataagtttgaccgatttgtttgaccacagcatcaaattgcaaatcggcggcggcataaggaccatggtttggcgaccaggtcgtcataaggatcaactcagctgttgtttgcttctgcaaggttgccacgatggttgtcaacgcctggcggtaatcagccagcgccgttggtgtggcgccgccaaccgcatcgttcgtcccaaactcgatggtaatcaaatcaggatgctgggcaatcaacgctggcagagcagggacaccaagattagtcgcggtttttcccacctctgcaatcccttcctctgtcaccgtcttgtcagtcaaatggtgtaattggtcagcaaaaagggtggtaaaccggcttgttttactatccgcaaacaaaccaacagagaggctgtcgccaaacggtgcatacacgagcgtcgtttgtgattttgccttcagccgggcgagcatgcttgtctgcttaatcgcagctgaggatcgcgaactaggcgacttgcggctgcgaagcgaagccgctgaactgctcgatttagccactttatgttgtaccccgcagccagctgctaaaatgagcaataaaagaccaaaacccaaccaaaactttttcataacatgccttctccaatgcaatcacgatgcgttagctaacaaaccgcgtgttcttagctttccaatcttctaatttaataaaaacccagaagccatagatccccaacgtgataattgtcagcaacaaccatttaatccaattgccgaacaagctcacggccgacccaaaaaagtgcatccgatgaccctcaatcacggtatgattgattttccaaccatatagcatggtcaaagcccatggataacaaatgcctagtgtgaaaatcgtgatcaaagtgccaagaatcgtccagccgacataagccaacaagccaccatcaaaaaaagagtgccgcccatatttcgtctccataatcgttgctgcctccaacttgttttctctagtgtagcagaactggtaggcagggtggaggaggatgcttgaattgtagcctttgatttattgcctacagccacaacagagaccggtggcaatgcgttttactgccatttgaatagaaagagagagctggcggagcggcgatgggctcagtggtgacattgttcttaaacgggtgggcttcccgttttagaacaaggccagactttgaaaccgcgcactttgcgggttcaaagctgtgcccaccacgttccagcccaatcgccgcggagccagctcggaccacaggtgaagactcacgtcagataggacgagaaaccttgtacatctgattttaaagaggtcatgattgaccactcgctcacgctccctcccaaaatttggtacaataggtcaaggaatttttcacttggtttttctgaaaggacgattcgttaaatggtaatggatgccgcattaaagggtatgaatgataagcaatctgaggcggtgttggcgactgaagggccagtgctgattatggctggtgccggttcaggcaagacacgggtattgactcatcggattgcttatttagttgaagaaaagcacgtcaatccatggaacatccttgccatcacgtttacaaataaggccgcccgtgagatgcgcgagcgggtcggcaagttggttgatgctgagattgcgcgcgatatttgggtctcaacgttccatgcgctctgtgtccgaattttacgacgcgacattgacaagctgggctataaccgtgcctttacgattgctgatcctgctgagcaactgacgctggtgaagcatattttggctgatttcaatcttgatccaaagcgctacgatcctaaatccattttaggtgctatttcgagcgctaaaaatgaactcgtggatccacaaacttatgccaatgaacaggctaacagtcctttcaccaaagttgtggcgcaggtttatgcggaatatcaaaagcgtctgcgcagtgatcaggcattggactttgatgatctcatcatgcagaccatcgtgctttttgaaaaagacaaagaaacactggcattctaccagcgtaagttccgctacattcatgttgacgaatatcaggacactaacgaagcacaataccagctcgtgcatatgttggcagaaggctaccataatttatgtgtggttggtgatgccgaccagagcatttatggctggcgtggtgccaatatgcagaatattttggatttcaaaaaagactatccaaaggcgcaagtcattttgcttgagcagaattatcggtcaactaaaacaattttgagtgcggccaatgatgtgattcagaataatcagaatcgccaagccaaaacgttatggacggaaaatcgcgaaggcgacaagattacctattaccgcgctcaaagcgaaactgatgaagctatttttgtcattcgccgaattgaagcagagattgccgataatcatcgcaaatatggtgattttgcgattctgtaccgaaccaatgcgcagtcacgggcgattgaagaagcgtttgtgaagtccaatattccatataaaatggttggcgggcataagttctatgatcgcaaggaaattcgcgatgcgctagcgtatttccggttagtggtcaatccggaagacgatatgagttttaatcgaattgtcaatgaaccaaaacgcggtattggcaacacaagcgttgagaagttagaggcctttgccaatgagcatgactggtccttgctggaagcagcggcgaatgctgaactcagtccgattgctggtaaagctcgcggacagttagctaagttcggtaaaatgatccagcagctgggtacacggcgacaagatctaaacgtgaccgagatgatgcaggcaattcttgaggatagtggctatttatcaacactgcgagcggctcacaatctggaagccgatacccgcatcgaaaacttagaagaattgctttcggtgacccaaggattcgattcccggtatcagccggaaaatgaagacagcgacattttcgttgattttctggctgaactggcgctgttatcggatcaggatgacgttgaagaagatgcacaagaagttaccttgatgaccttgcacgctgctaaaggactggaatttccggttgtctttttagtggggatggaagaaggactctttccattgagtcgggcttccatggatgaaagcgagcttgaagaggaacggcgcttagcttatgtcggcattacccgtgccaaacagaagctgtatctgtccaatgcctatggccggatgctgtatggtcaacggcaaaacaatcctgctagccgtttcattgaagaaattaatcctgacttgttggaagtcattggcactacccagccaaaaagtgacattccatttattaatcgtactgaccgcgcattcagctccccgtatagccgccacgctgatcaaaaaacagcaacacccgttactgtgcaagccgcgccaacaacaggtgcaggcaaaaccagttgggaagctggcgacaaggtgaagcatcgcaagtgggggactggtaccgtggtgaaagtcacgggtaccggcgatgatcaagaactcgatattgcttttaaagacaacggcatcaaacgactgctagctgcctttgctccgattgtcaaagtggcatcataagcgttcgcagtttgactcagaaatgtcgggatgcatatttttagaggaggctcgctgtgttagcaaaaccagctgcacaattcacacttgaagaagctcaggcggaagtcgaaaagcttcggaagcaactgaatcaatggcgtcttgagtattacaccaaggatgcgccaactgtgaccgataacgtctatgacgatcattatcgcgatttacaggcactcgaggaggcttatcccaagttagtcacgcctgattcgccaactcaagaagtcggcgatgtcattaattcggactttgccaaggtgcaacacccaattccgatgttgtcgatgggcgatgttttttcgttcgaagagctgagtgaatgggatgctcgcatgcaaagcaatgtcggccatccggtggattacaatgttgagttgaaaatcgacgggttggctttatctctgatttatgaaaacggcaaactcgttcaaggctcaacacgtggtgatggtaatgtcggtgaagatgtgaccagaaatgtgttgaccattgcgtcagttcccaagcagttaaagcagccactttcactcgaggtacggggtgaatgttatatgcctaaggcggcgtttgccaagctgaatgcgcggcaggaaactgagggcggcacgccttttgccaatccacgtaacgcggcagctggatcactccgacagttagacgccaaagtcaccgctgctcgagagctggataccttcatttatacgttaattgaaccagagcagtttaacgtgaccacgcagcatgaggcgattgcgtttatgcaggcacttggatttacaacaaatccaagttcagaagtggctggtgacatgcaggcgattgacacctacattaagaagtacaccaccgaccgtgatgcgttgccttacggaattgatgggatcgttttgaaagtgaacgatttggcgctgcaagcgcaactaggcaacaccgttaaagtgccacgctgggaaattgcctacaaattcccacctgaagaagcagagaccgtcattcatgacattgtctggacagttggtcgaaccggtgtggtcacgccgactgccgtgatggaccccgttcagcttgctggaaccacagtggcacgtgccacgttgcacaacgcggatatgattcgtgataaagatattcgcatcggcgacaccgtcatgttgcacaaagcaggcgacattattcctgaagtttcgcgggtactggttgctaaacgtccagcggatacgccaccggcgccgattccagaggtctgcccgtcatgtggccaaaaactggtccatctcgacgatgaagtagctttgcgttgcatcaacccgatgtgtccggcacaggtccaagagcagctcacccattttgcgtctcgcaacgcgatgaatatcgatggcttaggcccgaagattgtggcacagttgcaggccaaacatctggtaaaagatgtcgctgatttgtatcacctcacagctgcggatctggcgaaattagataagtttaaagaaaaatcaattaataatttgttaagtgcgatcaacaacagtcggcaaaactcggtagaacgcctaatctttgggttgggcattcggcacgttggcggtaaagccgcacgaattctggccgagcatttcggcgatttggatcatctgatgaccgccagtcaagaggcgatcgcagatgtgccaaatatcgggccgaccattgcggaagcgatcgtgacgtattttaaagccgcaacggttcaaaagttgatcactcagttgcgcgaagctgatgttaacctgcgttacaccggaccgaccaaaccagtggtcaaagatagttttgttgcaggaaaaaccgttgtgattaccggtaagtttgccgagttttcgcggccagcactcacgaagcagctagaaggattaggagccaaggtcacaggttcagtttcaaagaaaacggacctcctgatcgctggcgacgcggctggcagtaagttggcaaaggcacaaagcttgaatgtcccaatcatgaatgagacggaattgctggcgaatttgaaggattgaggaacatcaatgaagaaatttttaacgttaactttgctggctggggctgcggtgttgttagcagcctgtggcaagttgaattttgacagtggcagcagcagtactagtggcacaaaaaccggtagttaccaaaccaccggcacggttgataatagtatgtatcaaggcgttatcaaaaacggacgttatcagacgagcagcgcccgtggtttgacgttgcagcagaatgatcaaggcgagaacaacttcaatattaaaagtatggaaagtggtctcgaaaacctagccaaagcacagtttccaactgacaaatatagttttgaagaaggtcagttgttaagtacggcaactgctaaaagttggctgaaacgtgaagccaaggacaacaaagacggccttaatccggttgataatggcaaaaccgatcctgatacccgcaatccgatttatttgcagcagattttagagcaggatttcatggtgcaagacggtaatagtatgaagctgggcggaatcgcaattgcgcttggtatgaataaggttgattactatacaaagacggaatacggtgcccagtatcaaaccgaaatttccgatgaggcgatcaagaaacaaggtgaagcaatcgctgccaaggtcgtcgctcgtttgcgcgccatgagtaaagtaccgaataatattccgatcattgtcggtatctacaagaatgctgaacaagatagtctcgttggcggtgtttatactgagcagacaaccagtaaaaccggcaccaatttaggcgattggaagaagcttgaccaacagaatgaagtgttgccagtggtgagcgatcataaggcgattaacagtaccgtggccaatgacttttcgaattttacgaaccaagtgaagggcttcttcccgactttagctgggattacggcacaggcgcattatgaaggtggtaatctagccggcatgaacattacggttaacacacagttttatgggttgaccgaaattcagagctttacgcaatatatttcaacggccgctagcaagtatctaccctctggcgtgccgattgagatcacgattcagagcacgcaaggcatgcaggcctttgtatcgcgaagttctggcgacaaaggcttttatacccatgtattcgggagctattagccgaatctatggtaaactacgaatgataatgaaactgaaagcggggatagcatgatttctaaagacagtgttgcgcatgtggcaggattggccaagttgcaattttctgaaacggaactggagaaatacaccagccagctctccgagattctcgatatggttgaacaactagaaagtgttccgacgcaagatgtgccggtaactacccagagtattcatctggaaaatgtgatgcgagcggatgtcgctaagccaggcgagccggtagcggacttgttgaaaaatgtgccaaccaagaagggcacgttgatccaagttccagcgatcatcgataaagaggaggactagcgcgtggattactttaaaaccagtatcgatcaattgcatgagcagttacgctccggcaaggtgaccagcagtcaattggttgacgagacattggccggcatcaaccagttggatgctgaagtagatgccttcttagcgctgaatgctgatggcgccaaggaaaaggctgctgcagtagatgcagccggtattgctgacgatcaaccactagccggtgtgccaattgctatcaaagacaacattgtcaccaaaggcgttgtcacgacggcagcgtccaagatgcttgccaacttcaatccgatttatgatgcgaccgttatgcaaaagcttgatgcagccggtgcgatcaatgttggtaaaaccaacatggacgaattcgcaatgggctcgtcaacagaaaactccgcttttaaaacgactaaaaacgcttgggatcacacgcgcgttcccggtgggtcgtcaggcggctccgcggcagctgtcgcagctggtgaagtgattgccgcactgggcagtgatacaggcggttccattcgtcagcctgctgcttttaacggcatcgtcggggtcaaaccgacatacggccgcgtttctcgctggggtttgattgcctttagttccagccttgatcagatcggaacgctgactcgacatgttaaagacgctgcgcagttgctgaatgtgattgctggtcatgacgaacgtgatagcaccacagcggacacacccgtaccggactttaccgccaaaatcggtcaggatatcaaggggatgaagatcgctttgccaaaggaatacttaggcaaaggggttgacccagcggttgcggacaagattaaagcagctgccaagcagttcgaagacatgggcgcgacggtgacagaagtgtcactgccacatacgcaatatgcggtgccatcttactacatcatcgccagctccgaagccagctccaatctgcagcgctttgatggcattcgttatggtttccgcgccaaggatgtcaaaaatattgaggatgtttatgttcgttctcgatccgaaggttttggcccagaagtcaagcgacgtatcatgctgggcaccttcagtttgtcagccggcttttatgatgcatacttcaaaaaggcagggcaggttcgaactttgattacccgtgactttgaagatgtcttcaaagattatgatctgattattggaccgacaaccccaaccgttgcgttcaaaattggcgaaaaagtcaccgatccagttaccatgtacatgaacgacattttgacaattccggtcaatcttgccggcttaccggcggcatccgtgccagctggtttcgttgatggcatgccagtcggcttacagctgatcggcaaacattttgacgaaagcacgatcttccaagttgctgcggcttttgaagcacaaaacgactacttagcacagatcccgggggcaagtaagatgaactttgaaacaacaatcgggcttgaagtccacgttgagttgaaaaccaaatcgaaaatgttctcaccatcacctgtcacttatggtcaggaacccaacacccagacaaacgtgattgactggggattcccaggcgttttgccgagcatcaatcgcggggcctatcaacttggcatcatggtggggctggcattgcatgctgacatcacgcgtttgactcattttgatcggaaaaactatttctatcctgacaatcctaaggcttatcaaatcactcaaagtgagaagcctttgggcaccaatggctgggtggaaattgaagttgacggtaagaagaaaaagattggtatcgcagaactgcatgttgaagaagatgccgggaagaaccagcacgaagacgatggttattcctatgttgatttgaaccgtcaaggcacaccgctggtcgaaattgtttccaaaccggatatcaccagtccagaagaagcttatgcttatctggaaaccttgcgccaaatcgttcagttcacaggggcttccgacgttaagatggaagaaggctctatgcgggttgataccaatttgtcagtgcggccaattggacaggaacattttggtaccaagaccgaaatcaagaacctgaactccttcgtgcatgttcgcgatggcctcgcatttgaagaaaaacggcagcaggctgtgcttttgagcggcggtgaagtgcgtcaggaaacccggcgctgggatccagatgctaaagaaacgcttctgatgcgggttaaggaaggcgccgatgattatcgttacttccctgaaccagacctgccaccagtggctgtttcccagaaatggattgacgacattcaggcttctttaccgcaaccgccagcagagcgccggcagcgttacatcgaagactggggaattccagcttatgatgccggtgtcctgacgcagacgaaggaaatgtcagatttcttcgaagcaactgtggcgcaaggcgctgatgccaagcaagcgtctaactggctgatgggtgaggtttccggtttcttgaatgcccaacacgttgaactggggcaagttgccttgacgccagcgcatttggcaggcatgatcaagcttattggtgatggcacgatttccagtaaaatggccaaaaaggtctttaaggaaatcattcaacatgatactgatccggataagtgggtccatgaaaaaggtctgatccaactttccgatccggctaaattgaccccgattattgacgaaattctcgataataaccagcaaagtatcgatgacttcaaagctggtaaggaccgggcaattggcttcctagttggtcagatcatgaaacaaacacatggtcaggcaaaccctaaagtggtcaaccagattttgatggctgagattaagcaacgataagtgatactgactatctagcaattcagttcggataatagcctcgacatgtagacaatgttctttgttgtttacatgccgaggttattgcgcaaattgctagtcttgctattgtggcggcagatgggaagtaccaagaaaaataggctcaaaagttgctcatgattgaagcttttgagcaagacattgacgattcacgattatgacaaagactgtttccgccagcaacgggccagcattccagtattgttaaaacgtttaaggagcattgaccgatgagaaaacgggcgcgtttgatatacaaccctacatccggcaacgaaggtttaaagcgcttcgtccccgacattttggatatcatggaacaggcaggatatgaaagttcaacctttcaaacaaccccgaagcctttttctgcacgtgaagaagcaaagcgtgccactgaagcgggtttcgacttaattgtcgctgctggtggcgatggtacgattaatgaagtggttaatgggattgcaccagctaaaaaacgcccaaaaatggcgattattccagcagggacgaccaatgactacgcgcgtgctttgcggatttcgcgggatgatccggttgaggcggcccaagtgattctcaaaggccaaacccttgcgatggatattggccaagccaatcatcattattttatgaatatcgcggctggtggtttgttgagcgaactcacttattctgtgccatctgaagttaaatctatttttggctattttgcctatgtgattaaaggcgccgagatgttaccagcggtgcggacggtgccgatgaaactggaatatgatggcggggtttatgatggacccgccagcatgtttttcctcggccttaccaattctgtgggcggttttgagcagatcgtgccggatgctgcgcttggtgatggcaagttctccttaattattgttaaaacagcgaacatggcgaatttgctgaagctaatggcgcttgtcttcaacggtggtcgccacgtggatgatcccaatattatctatacaaaaactaaaaagttgcgggtgaaggccggcggagacgatccgttgaaaattaaccttgatggtgaatacggcggcgatgcgccgatgacgtttattaatttgaagcaacatattgccatgtatgctaatctagacgagatcccgaccaagaatcttggtacggacgcgcagaagcagaaggactacatggccgaagtcgaatccatttctcatcaagatattgatggtgatggacagatcggctcacaagacgaaaaggatgactaatttggcccaaccagctgtaaccaagaaccaagatctggaagttaccattcaagatctcacttatgaagggatgggcgttgccaaagtcgacggctttccgcttttcattgaagatgccctgcctggcgaaaaaatgcaggtgcatgtcctcaaaacgcagaaacaatatggctttgccaaagttgtcaaacgattgagcgactcaccggatcgtgttcccggtgcagatagcacttatatccgcacggggattgcgccactgtcgatcttggcatatccggcacaattgcaatttaagcagaaacaaattcaagaactttataaaaaagcgcatcttgatattgcggtgctgccgaccatcgggatgacgaatcctttaggctatcgcaacaaggcgcaagtaccggttcgtaccgtgaatggcgaactgcaaactggcttttataaaaaacacagccacgacctcgtaccaattgaagactttctgattcaagatccgaaaattgaccaagccattgtggtggtgcgtgatcttttacgaaaataccatgtgccagcttatgatgaacgcgctaataaaggcgttattcgtaacatcatggtgcgccggggccattatacgaagcagatgatgattgtcttggtgtcacaaacttggcaagtgccgcatctcaaagatattgtcgaagagatcaccttagcattaccagaagtaacgagtgtggttgtgaacttgaatgacaaacgaaccaacgtcattctaggccgcaagtcacgaaccatttacggcgaggactatttgctggataagttgctaggcagtgaattccagatctcgccagtcagtttttatcaggttaatccgattcagactgaggtgctttacaaaaaggccattgaggctgctggtctgactggtaaggaaaatgtgatcgatgcttattcaggtatcgggacgatttccttgacgatggcacgtcatgccaaacatgtttacggcgtcgaagtggttgaacctgctgtgcgcgatgcccgggcaaacgcggtgcgcaatcacatcgataatgtcacctttgaagtcggcaaggcggaggaggtcatccaacgctggaaagacaacgaactgccagtggatgtgctcatggtcgatccgccgcgcaaaggactggataaaagtttcatcgacgctgtcggttatatgaagccgccaaagatcgtctatgtgtcctgcaaccccgcgactttggcaagagatttgcagctgctagccgcctttggctacacagcaaaggaaacccagccagtggacatgttcccgcagacgcagcatattgagagtattacggctttggcgttggcgaagtaagactgcacaactatcatggcgcaactcaaagaggcacccgcacatcaattgattgctgcgggtgcctctttttgactgtagcaggtatgaatatctgttgattcagtatcagttctatttcagttgagatttcgccttagtccgagctggctccgcggcgattgggctggaacgtggtgggcacgacttcaagcccgcaaagcccgcggtcttgaagctcggccttggtctaagcggagaaaaccactccactaagaccaatctcaccactgagcccatcgccgctccgccagctctcatgattctattttagaacacgatcagcatgtcgatcttattgttgattgaggctcgtatttggcacaagcactgactgaacgacaagatcttgattctttgtgagtttgcagttgtgtccaccactcaagcttcgcagtcggcacccctgaattgccgcggaaccagctcgaacttttacactaggcttttattttgggcaaatcatgataacaccctaaatatttgctcattcaagttgctataatagggccatttcccttatgatcagtagcagtgacaagaaatgggggagtatggtgcagcaaaagactttagcaatgaaatggttatttctgggttcgttgattacgaataccgggatcagcctgatctggccgttaacaacgatttatatgcatgaatatttaggtgaaccactaacggttgcagggattgttctttttgctaattccatgtttatggtgatcggtaacagtttcggtgggtggttatttgatcattggcagccatatgggacagttcttgctggtattggcctgaatctttttgcgactggtatgctgattttcttccatggatggccggcttatccactgctgttagttgtgtccggtcttggcagcggtatcacaacgacggcgattaattcctatgcgactcggattcagaataaacgaccgagtgtcgtgttcaatattctctactttacatcgaatctagggttggttatcggcactttaattgtcggatttgtgctgccttatggtattggcgttgttttcgctttggcaactggcttatttgccttatttttagtggttgctttgttgcattatcgaattgataaagtggcgattgcgactgcgaccacgcaaactgttagcggcgagcgcaacccagccaagccgcggttagtcatgttgatggtgaccttatttgtgacctggctaatgtatgagcaatggcagagtaatatttctgctttcatgttaggcgaaggtttgacgattaaggattatagtttcttgtggacgattaatgccttactgattgtgctattccagccaattttgacggcgtttgatcgctggttattgcaacacattcgcttgcgtttgattggcggttttgtcttgtttgccggatcatttttgcttttgttgaacggttcaggacagtatataacgttcatcgtggcgatgattgttttaaccatgggtgaagtcttggccttaccagcagtctcgacttatgtcaccttgtttacgccattggcacagcaagggcgttatcagggattgattcaaggctttgcttcagctggtcgcgcattgggtccgttgttaggagcaatggtgattgagggcaccggcagctatcagttgttgtttgttggtgccacaggcttaattttgttggcggctttgggttttgccttcagtgttcgccagagtattccggccctgaacgacccattgcacccggttacccaccagcagtcgtgaaggctgaaaagaatcgttcgaggggattatgaaaaagagaggggcttttgatttgcgttatcgactgattttaagtgacattgacgggacgctgctgaattcaaatcaccagttgaccgatgaagttaaaacggccatcaaggaatacgcggctgctggcggaacctttgtgctggcttctgcgcggccgcctttggccatgactgcattggcacatcagatgggtctcgacgtgccacttgccagtctcaacggcgccgtcatttgccaaccgcaacatggcgatttaaaaatcctgtccgcaacgccttggcccgctggcattggtagccaagcatacgaagcgttagctaaactggcactcagtctgaatattttcagtggcgcgcattggtatgtgaacgtggtggatgcgtgggtccaacaagaagccgcaatcacaggctttggcgcagaaactgtgcctatggaacaaatgctggcggaaggattgccagtgcataaaatgctgtgcatgggtgagcctgctgtggttgatcgcgcggaagccatcattcttgcccatccggagtggcaattggtcgctagccgttcgaaacgaacctatctagaaattgtgcggcaaggcgtgtcaaaagaagccgctcttcgccaactcagtgacctgtttgccatccccatgactgagacgatggcgttgggcgatggcgaaaatgatttgccaatgttaaaaactgctgcacttggggtgaccttggccaatgggttgcctgtggtattagatgcaattaaaactgttgtccctgacaacgatcatgatggtgcagcggtcgccatcagaaaatatgcgatggccaaagcataatcaaaaaggcgccttgacaggattcaattttgtcgaggcgtctttttattctgtataaaatagttttaaacgaatctatttagtccttcaaagcctcaacagcatgttcaagctgctgcttttgagcatcggaaatctctggatattttagcggcaaagcggtgacttcttgattgataatctgcgaaacaatcagccgtgaataccatttatcgtcagatggaatgatgaaccaaggattggctttagttgccgtgttctgaatagcctcttgataggctttttgataatcatcccagtagcggcgttccttaatatcagccagtgaaaacttccaattcttttccggaacctcgatacgcttaaggaatcgatttttttgttctgctttggaaaggtgcaggaaaaatttcaaaattagaatcccgttgcgccgtgcgtaagcttctaaagctttaatatcattgaaccgttcagaccaaagactatcggaaacgtcctgaacactgtcgataccaggcaggttttccttgagtaacaattcgggatggacgcggtcaacgaggacttcttcatattgcgagcggttgaaaactgttaattcgccgccagcggggaaggccttgtgaatccgccacaaaaaatcatgatctagctccagctcagtcggcactttgaacgagacaactgaggtgccttgtggattaaccccagacatcacatgctcgatcatactgtcttttccggcagcatccatgccttggaaaatgatcaaaacactgtattgtttttgcgcggctaaatgttgctgtacttttgataatgttttgatgttattctcaatatctgctttaatttgatcttttttatttttaaaactatctggcggtgtggtcgtgaaggctttcatatcaaacttgcctttaccgtcaaaccgatattgttctaatgccatctcatcaccctctctgtcttattgcttttaagatagaagtttcaaggacattgtgcaagcaattgacgcgcttgcttagtcaaactatgcttgcattatcgcatttaaaaaccgcaggaggagcatcagattttggttcgacgaatgcgcttaaaaggaggaattttgatgtcattaccacgtattcaagatgatttatatatggcggtcaacgggacttggcagcagaacacggtgatcccgcctgacaaaagcgtcgtgagtgctgacagtgatctaactgatagcattcgaatcaagttggtagccgatttgaagaaaataaacgcggcaccacaagccgccgatttaccactgcaaaatgccgcacgactatttgctaaggctaatgataaagttcgacgcaaccaactcggcatgacaccggttcgtgcacggctggataaaattgctgggcttaaaacgctggcccagtttcgtgcagcactgccaaaactactagcggagcaatatgtgttgccagtaagcccgtacgttgatgctgatatgcacgatgcggctcacaatattttgaatcttggcggtccggccacgattttacctgacgctgccatgtatcaaaccgatgatgcagagaatgcggcagatttagctgcatggtcgaaaatggtcgcgacgcttttgggtgaggccggttttgaccagacagcacaagcgcactatgtggcggcggctaaaagctttgatcgccgattggctgcgttcattccggcaaatgtcgattttgccgttgatagcacctttgacaatccgctaacctggactgaatttgtagaagatgctggcttcttaggcattcccgaagctttggctgctaaaatgccgcagacaccgacgaaggtcaacgccgtggtgcctgcttatctgccgcatctgtcgacattaatcaccgaagcaaactatccagagtggcaagcatggatgctgattagcgaactattggcttgtgctgattatttaagcgatgatagccgccaacttgctggtcaatatgaccgttttttggctggacagcctgagcccgaagcttgggaaaagcatgcttttggagttgccaacgactattttgatgatgcaattggtcagtattatggccaaacttattttggcgcggatgcgaaagcggatattaccgcgatggtcaaggaaattttgcaacaatatcaagttcaacttgaacacaatacttggttaagcccagcgactaagcagaaggctatccgcaaattagcgactatgaaaattaaaatgggttatccagatcaacttttcccgctttacgcgaccctgcatgtcgagccagagcctgatttactgccgaccattttgcaattgagccagcagacgcaagacttttggcttcagcaggtgggtcagccagtggatcgcaatgtttgggggatgccggggcaccttgtgaatgcctgctacgatccgatgaaaaatgacatcaccttcccagccgggattttacagccgccatactactcactgaactggacccgagcgcaaaatcttggcggtaccggtgctaccatcggtcacgagatttcacattcgttcgataataatggcgccttgtatgatgaatacggcacgttaaataattggtggacggttgaggacaaacaagccttcgacaagttagtgacagctattgcggatcaatttgacggtttattgtatgaaggcgtcaaagtgaatggccgactgacggttagcgaaaacatcgccgataatgccggcatggcggtggcgttggacttgttaggggattcggctgacccgaaagtgctgcaagacttctttattgcctatgctcgttcttgggcgaccaaaatgcggccagagcgcgctaaaacggtgttgcggcaagatgtccatgccccggcgaccttgcgggttaatgtccctgtgcaaaactttgaggcgtggtatcaagctttcgatgtacagccgaccgatggtatgtatcgactgcccgcaaagcgcgtcacgatttggcgtcggtagcatttaaacacatttgttttaaataaaaccgatattagtaggcctatcttgtccctgaaatcgcctcataacgctgtgtgtcagttattagttgtctttaaatctaaaatgaaactgagatgatcaccatgagcgccagccgtcgttggttgattttgattgcaacttcaattgtgtcctttatggctacattggatgccagcatcgtcaatattgctttgccctatattgcccgggagctgaaggtgccgatgagcaccatcgaacttgtcacatcagtttatatgatcgcgatttgtgtcctgcttattttctgggggaagttgtctgacagtgtgggtcggatctagttgtttcagttggggaccattttgtttgcactaggctcgcttttttgcggactatccatgaccttaccatggttattaacggcccgactgattcaagccactggagccgcgatgacgatggcgactaattttggcattatcaccgccatttttccgatgaatcagcatggtcgcgcgctcggggtcaacagtgccttgttgcaactcggcaatatcgctggtcccggtattggcggcggggtgttggcggttttaagctggcattggatctttttgattaatgtgccggttgcgctggtggcgtttttaattggcgtgctggtttttccaaggcagcggccgtccttggcgggtgcccacatggattggccgggatatggcagttattcggtcatcattttgggctttttcatcacggtgttctgggcacaaacagccggattgtcgtgggtgacgctgttaccagggatgcttgcgttcgtcgctcttgtggcttttgtgcagattgagcgatatgcatctgatccgctgattccatttgccattttcaaaaatccgggtttcacgattggtattctgactgcgatgatcgtctatatgctcggctattttaatagcgtgatcatgccgttttatctggaggaaacattaggcttgagtgcgttaacagcgggcttttgtatgatggcaattccggcggccaatgttatcagtgcgccaattggcgggaatctgggcgatcatttcggagcagaacgggtgtctttcttcgcgctgtttctctggtgtatgccgatggggttgtttgccgcggcaaccccaaactggccgttgggttggatcgtgtttggcctcgcgtggtcaggattggccaatggcgcttttcaaaacaatccgatgatgatggacaatgtcgcgccgaagtttcaaggactggcggggtccatggctgcgcttggccgtaatttggggatgacaataggtgttgccttggtgacaagcttgttgtacctgaatatgagtacgcaggccggtcggtacattcatgattatccgcatggccatccccagtggtttatctatggcatgcaccgcagctatgattttgctctgttactcttattgctagctgtgctgctgctaggctggttgaacctgcatcggctgcacgagcgtaaacagtcgttaagttgaaaattaaaaaaagagacaagttctgcgaccgattatcaggcgaaaacgcatggtaaacagccgaaaacttggctcttttttcagattaatctttgccagcacgatcataatgaatccagccagtttcacggacgccaagctgatcatacagatgctgggcggccatgattgctgatccgtgtttgccaactgcagcctgcataaccgcgctcatcagccagttgaaaggcagcctgcatcaattgtcgggccaaaccgtggcggcgaaacttaggggcgacataaacatcattgatgatcagcaacggcttgagcgtgcgggtgtcaaaactacgataaagaatcgcaaagccgaccagttgctggtccaactcagccacaagcaaagcccctaatgtggcatcagtccgtagctgattcagatgagcagccatggcactttcatcaatcgtaagtgggacagggctgtcatgataataaccttgaacgagtgataataaaggcgagacgtcgttggtgatggcagggcgaatggacattggaaaaacctccttggccataatcttgtcttattttaccttgaagtacgcctaattagcaccttttcatgcttgattaactggcttttggacattctgaatagctaccagacagactaaaaaagactgatttgccatatatagacaaatcagtcttcgctctcataaatagtctgttggaatttaaagattgcagcatttggcatggcaaggaagttttagcttagcacttcatatgattatttgggctctgacaaattgtaggtttcagaagttatcgttcagcctgagagacagtcattgccgatcgtcagtagccatcgagaagaccgcgacacaaccaaagccggtgtggctggcgatggtggggccgatgttgccgacttgcagcggtgtttcaggtgaggcggcatgcaatcggtctttcacgaagttggcggcgtcataatcgcctgacgttgaaatgatgacccggtgcgtcgggttggctttaacagccttcagtgtttcatcagttaagtcgatcagtgaacgttttcgggcgcggactttgcgcacaacgcgaagtttcccagcagtatcgacgtccataaccggcttaatattcagcatcgttccaagggctgctgatgtccgggaaacccggccaccatgatacagaaaatctagcttatcaacggtgaaccacatccgataatgcaaccgatgatctgtcagccattgcgctaactcagcaatcggcatgccagcatcgcgtttatcaatcgcatccaacacaaattggccttcccccgcgcaagcggctaatgtgtcgattaaataaatttgggcatcaggatgcttttctaacaacatcgctttagcctgtgttgcagaatcaaacgtaccgcttaaaccactggagaaaccaatgtatagaatcggtgttttggcttcaacataaggtgtgaagaaatccacaaattggccaacgttgacctgtgtcgttgttggcatcacattttgcttgagctgctggtaaaaggcattgatatcgtatttatcttcgccaagatcgtcttcgtattcctgaccatcgattgtaaaatgcattgagacaaaatccacatgatgatcgtgtaatgtttgatagggtaagtcgcagcaagaatcggttaaaagctggtacattaggttcacctctcgttgcccgtggttagccacggggtatttccatcaatgttacgctgttttatctatttctgaaagtgccgcacggcttttcaaacatagcgagtgttttttaacgcctaaaaacaagagctagttgcaaatcattggccaacaacggcctgttaagacggcattttgtttagcagaaggaaaaagctgacttttgcccaaaaaagccgaatagcagtcatcgtgctattcggctgtgaccggatcagttattgtcggcagtcttcttttggttaaataaggtaccgactgctgggatgctaccgagagaatcaatggcagtgcttggcagcacaactgtgttagcggtgccctttgccagcgcttcaagtgcttcgacattcttgtattgcaagtacagattgccgttatcaatcaggccggcattaatcgaattgatctgatctttgacggcatcggcaatgagtcgctgactttcagcatgaccttgcgcctgcaaaatctgagtttgtttgttggcttcggcttcaagaatagccgattgtttttcaccttcagctttggcaatggcagcctgtttgtggccttcagcttccatgatgttggcttccttttcacgagaagcacgcaacagtttgttcatggaatcctgaatcgtggcgtcaacttggatggaatcgatgttcacccgatcaacattcaggccgtaaccagcagtcgtttcggcaatttgctggaacagcgtttggttaatcgtttcggttccgttcaagacatcgtttaaatccatattgccgataataccacgcaagttagcgcgggtatcttgcaccatagaaagaacggaatccttgttttggtaaacataagcattaacgttggtaatatgatatttcaatgtttcggaaatgcggacgacaacattatctttggtaatgacttcctgttcgtcaaccttcaacggaatttgcttcatgttgacaatttcggtaatccgataaattagcggtggcaccatgtgaaaaccaggctctaaggttgccacatatttacccaaccgttccacaatgccgacttcaccagtatggatgatggcaacgctggagaaaagaatggcaacgacaatgactaggacaacaacaattaacgagatcaaaataatgctattcataaaaatcactccttcaaaacatctaaccagatgtctatgaatttctactgatacgggtgacatgtattaggaacttggcgtggcttaataatgcaaagcatgttccggttttaccacgctgagatacaacggcgaaatagcgttgacaacgaccttgtcgccagcggctgcatcatcttggactcgataatgataatgaatgccataaagggtgatttcgccactcgcggccgaagttggcaacgtaaaaatcgttcctaagagccgttcatcaagcatttatccgtctccttcccagttccgcgattgcgtttggtggaagcctcatcagctttgcaaagcaatcgctatcacacgctaattctaaagcacgggtgagggaaagacaacgatgacgacttcaaaaagcaagttatttgcttatgttggataaaattactattgtttttgcttgcttctattcttattggcctttacttaacagactgtgacgttgataaaaccaaatttcgcgaaaatgatcgactttgctacaatggtaaaaaaagagcgtgagctgacccgattagaaaccggcgtgtaagcggcgtcaagcgtgatggccgcacttgggccattgcgcttgaggtccttacacaaaggtttctgggtccgcgatcgcgtttaaaaagagcgtgagccgacccgattagaaaccggcgtgtaagcggcgtcaagcgcaatggccgcacttgggccattgcgcttgaggtccttacacaaaggtttctgggtccgcgatcgcgtttaaaaagagcgtgagctggcgcgggtagcaaccggagcataagcggcttggtcgttgcggccaaggttcttatgtggaggataatgcgccagtgaaggcgtttatacgaggaggggacactgtgcgcagtcgggtcatttatgctgatacctatcgcaaacgtcatcaaagacggttatttttgctggccgttttaatcatcgctttgggcgcactgtttgtttggtggcatcagcgcaatccccgccctgatccgcagacctatcccgtgttgggcgtgcgccttgaccaaaccgatggggtgcaggattttgacagtttgcgcagcagcaaagtcagttttgtctatctcaaagcgactgaaggcagcagctattttgatgataattttaatacgaattttaatcaggcagctggcagtcgactgagcatcggcatttaccatgggttcagctttgaaacgacaccccaagcccaagctgcccaattcacgcgccaagtcggccaaaatatcggtgatttaccgattggcatttacttaagctattacactgaaaagaagccaagcacacaatggctgacaactcagttacaaacttttgtcacattggtgcagcaacattatcatcgccaagtgttgctgatgggtagcccaagtattttaaaagctgtccaaaaagtcgacccgcaagcaccacgctgggttgtaagcgacaagaagccgacaacgagcagtggtttctggcaatatacgtctggcgcccggttgccgaatgggccacacgcagattaccgtgctgccgtatttatgggggatcgggcggcctttttaaaactgtctcagcagatagtcaattaacgccaaacacgggaattgtcagctaatcataatttttgtggctgtatatgacaaaagtgttcgttgattgttcgcgaaaagccatgtcaaccttgacaccaatgcggcataatagttgcgaggtgaaactggatgaagaaagttttgatcggccttgttgtgctgattgtgctggtatttggcggcttgaaaatttttgaaatcacaaattatggtggcacgacttattacacgaagatcacaaacgctggtcaacaggccactgaccatgatcaagatggtaataaatacaccatctatgcatacgacttgcccggctatgatgaaaaaggcagtttgcagcaactgaagttcaatgctaatcaagaccgaccacttaaaatgaatgcttatttgaaagtgatatacaatgataaaaaaggcgtcactgattggcagcgtgtcccgcgagcagaagtgccaaaagcggcgctggcaaagttggactagtcaataagatgccaaaatgtttcatagacgtgaaggttaattcaactaaataaaaacggctgattttccgtattggaaaatcagccgttttttgatcgctcatagataacccagcagaatttacagatgacagtgccaagattgagccacatctagccaaagattacagcgtttggcacggcaaaaatctgttgatcaacttctgatgactttaaacactcggaacaataatcgcataagtggcatcttcagcctcgtcgtagatcgtttgcggaccattatcgtcggccgtgatgaccaacttatagccgtaatggtcgagaaaagtcagctcatggatggtgatgccgacgacttgaccgggaagcactttgttgtcgattgcgatctgcagttgtggcgagatcgccagcgagtgggtcttgttggtttgctcatcgagaaatgcaaaattccccgtaaaattcttcgccaatgccaatgcaggattggctgccttggtttgcgactcctgatgatgaccccgatgcgcgagtgcatgtttcagcccgcgtaaaaaactcgccatgttattcgacctcccattttttcattacattaagtctaccatgactttttcctttagtggttacagtgatgctgtttttctgttactgggctgttacaataatggtaagcggttcagagacttgtcaaaaatactttgtttttaaaaggatgacggcaactgaatcgggataagcgtgcgtgatgacgcttgatgattgaccgtgtgagttgaagaccgccagtttatgaaggccacggcttaggcggtttcgcggtgtctggcatgtgcatcagcacgttaaaaaacagagcacgattcagccagtttctgagctgaatggcgtgtctgaaaagggggatttgccatgttaaaactcggtgtgattggaacaggttggatcaccaagcaattcgtggcggcagcgatggcgacgaaagcttatcagctcaccgctgtttattcgcgacatcaggaaagcgcgcaatcatttattgacagcacggcaccagctactgcttatacgacgatggatgcttttcttggcagtgatatcgatgttgtttacattgccagtccaaatagtttgcatgcgtctcaagcgttggcagcgttagacgccgataagcatgtgatcgtggagaaaccattggttgccacgaccatggagtttgaaaagttggacgaagcgttgcggaagaaaccttctttatatctgtttgaggcagcgcgtcacgtgtatgaacacaactttgaagtcgtcaatgatttcacccacagtcaaccggttgatggggccaccttaacgtatatgaagtattcgtcaaaatacgatgcctttttagctggcaagttaccgaatgtgtttaatcctgaatttgccggcggcgctttaatggacctcggtatttaccttgtatatgatgcgattgcgtggtttggtgtaccggagaatgccgtttatttgccgcattttctcaaaagcgggattgacggcgatggcgttgctcggctcgactatggtaagtttgcggtgacattgatcacgggtaaaacgactaatagcgagttgccgtcagaaatttattctggcaagcaaacattgatgatggacaacgctgctgagctggagaccgttaagctcggtgatcaagtgctgagcaaagaaaagttggctaatccgatggaagcagaggcagcctattttgcaaaagcaattgtcggcaaggaccgcaacgcttttgacaaggcatggcagctcgccaaagaggttcatcaagtcatgtcaattctgcggacctccgcaaatctggatttttagtgaggacaatattgtgacaattgcaaccccgttccaaaaacgctggcaagcagccggctatactgaacagacgccgattcaaaccgccgtgtatcaaccactgaaagccgatgaagatgttgttgggcttgctccaacaggctcagggaaaacattagcttttggcttaccactacttgaaaagatggtgccaggcgatggcttacaactcttaattttggcaccatcacaagagttggcgattcaaacccgtgatgtgcttaccccttacgccaaagatattggtatcaccgtgcaaggggttattggctcggcgaatgtcaaacgtcagctcgataggctaaaagaaaagccagaagtcattgttgcaacggcgggtcgcttattggaactgattcagtcgcgtaagttgaaacttgatgggttgcaaacgctggttgttgatgaagctgatgaaatgttgcgtgatccaggatttgatcaggttcgagagattgcggcagcagcacccgcggaagcacaattggcttttttctcggccacgccaagcccttattttaaggagctgcataagtggtttggtaaaacaccagacatcattgatgttcgggcaattgatcgaacccgtggcgaagtcaggcatctgtttttgcagacggatcgggcgcatcaggttgattggttacgcaccttagcccataccgatggcttcaaagccttggtcttcttcaatcaaaattcgtccttggaacgcgtggcggggatcttgcgtcatcaggcggttcgctttgcagtcttgtcacgcgaaggccggcaaacggttcgacagaaggcattgactgattttcggcgcggacgaatcacgctcttgctggtgaccgatatggcagggcgcggcttggatattcctaagttgccggctgtggtaaactttgaaccaccgaagcgcgcggaagtttacatccatcgggctgggcggactggccggatgggtgaagcaggtctggttgtgaccctgggggatgatcatgatcgccgcgacctcagcaagttggtaccgcagtatcatattcatcgcggctatatgtcagagggcaagcttgtggacacgccgccagctaaaaaagtgtccgaggcgtcggcaccaacgacggttgaaaagcctgcatcgccagtcgccaagcagcagccagttaaaccagaagtggcacaagaaccggctgttcgtccgcgtcgcaagcataagaaacatcgcctgcgagatcagcggaataaaggcaagcacaaggataacgcataatgcagcatcggatgtatgatgaagataagggggcagtcatggtgagtatgaaagcagaacaaatggctgccatgatgacattgatgagcgctgccggtgatgcggaaaatgcaaccatgacggcgattgacgaagccaaggccggccatgctgagcgcagccgtaagctgttgaagcaggcagatgccaagttgaagcaagctcatcaagctcagacccagatgctgacgtatgaagcacgaggcgaaaaagttgacgtgacattattgatggtgcacagtcaggatcatctaatgagtgcgatgaccattcgccggcttgccgatgagattattgatctttatcagcaagtgcaggcgcgtaaataacggctggtacagcgcggttgacgtgcctgcaaccgcggcaataacgcgctcgcaatcaagagaggtaatccccatgaaaatcgaaaaaacattacagacaccagcagcttttttatatagcaagattattgcgcccgtacaagctgatattgcggcggctaacaatcaacaggttgcggcggcagaactcggtggttatgcttatcgcaagcaatttccagatggcgagtgggccaaagttaaggttactaagaatgtgattgatcgtgaatttgcgatgttgaccgtcacccgtttctcgcggttcaaggtccggtacctgatcacgccgttaaatgccaatgccagccaagtccgcgtcagtgaaaccgtgcagccggttaactgggcggcgcaattgaagcaaatggtgaccgaattattggtcggtaacaaacgccgccgtaattacggccggatgttggattcgatagagcggtcgtatatgacggcttaggcgttgttcgctgcctgctgaacactttatagtcaatatttgcaaatgaatttgaattgccctgtggcttttggcataattgactttgtctggtgcccttagctcagcaggatagagcgactgcctcctaagcagtaggtcatcggttcgattccgatagggcacagtacgaagcacagtcttgatggctgtgcttttttggaaatcacattgcacattctaaaaagtcttaaagattaaaaatgagtgcaatcgcatttttgcggtagctggatttgtctaaaaggagattacgcgatgcaagccttcacagccgtttatttgccgggctggttgattttcattggcggtatgctgatcattagcagcgtgaatgcagcgacggtgcaagccatggtgaatcgggccgggcgttcgaatacgcagctctggtatatgaaaccgggtatttttgtgcacgagctgttgcacgcggttgttgcgcggctcttcggattacaagtgactaacttttccatgcgagctgatgtggttagcggcagcgcagcgcatgtcagtctgcggtacaatcggcgctcgctttgggcacaactgggattatttctgtccagcagtgcacctgtctggggcatcagtaccgtgttgctgatcatgggacgatgggccttttttccgacagatggccggctttggccagtcttaactgccgccacgagtctgaatgaaaaatggctcgcgatgcgcggcttgattcagatcaactgggtttggtttgcggcttttatcgtcacggccttggtgctgacgccaggcattgcgctttcagctcaggatctgcgcaacatgtggcggagtgccccgatcgtgttcttgctgacaatcgtgattttttatgtttttttgacgttttggccagctggatttgcttggtggtcgctgttgaacttgaatgtgttattgttagatgcgattatgctgcttttcagtatcttgatttggttactggcaagcattttgtgaatgaatgttgacaagtgagagggcaaatgtgcccgatgtcataatttataagtgaagccttttgttctttagtagggggaagacgatgattgcgccgcaagcggagacaattttaaaggaaaaatttggctatgatcattttcgtgctggtcaaaatcaggccatcagtcgcgttttggctggtgaaagcacgctggttgtgatgccaacaggcggcgggaaatcgttgtgttatcagattccagcgatgttgttgtcgggattgacgctcgtggtgtcgccgctcatcgcgttgatgaaggatcaggtggatgcgctgaacgataacgggattccggcggctttcattaatagtacccttgattatcaagagattgctgatcgccttgatcaagcaagaagtggtcagattaaattattatatgttgccccagaacggtttgacacggattggtttgtgcaacggcttggcagcaccgatatttcgttatttgcaattgatgaagcccattgtatttctcagtgggggcacgattttcggccgagttatttgaatctggcgaatgtggcggctcaattgccttcgcagccaccggtcattgccttgaccgcaacggctacaccgcgagttgcgcaggatatttgccagcgactggcgattccggctgacgggatgattaatactggttttgagcgaagtaatctgagcttcaaggtcgtacgcgatcaggatgaagatcggtatctactagattacctgaaactgaatgtcgatcaggcaggcatcatctatgccagcacccgaaaagaagttgaccgtttgtatacctttttggcacataagaagttgcctgtggccaaatatcacgcgggcatgagtgaagcgcagcgtgctgctaatcaggaagattttttgtttgatcgcaaaccaattatgattgcaacgaatgcgttcggcatgggtattgataaaagcaacgtgcggtttgtcattcacgcccagattcccaaagatgtcgaatcgtattatcaagaagccggtcgggctggtcgtgatggcttgccgagtgaggcaattttgctgtttaagccgcaagatctccaggttcagcggttcttcatcgatcaatccgaaggcgatgacgagcacaaacagcggcaatatgagaagttgaaaatgatggaacggtatgcgaacacagatcagtgtttgcaacagtttattttgaactatttcggtcaaagcgggacaaaaccatgtggtcggtgttcgaattgtttggatgaccgcgaatcggtggatgttacggttgatgcgcagaaggtcttatcttgtgtggttcgcttgcatgaacgttttggcaaaggcgttgtggcacaagtgttggccggagcccacaatcagagggtattgtcgtttcatctagatcaattgtcaacttatgggttgatgagcagtcgtcgtcaacgcgacattacaacgttcatagattttctggcggctggcggttatttagaaacccgcggtggtcagtacccaactctgggcttaacggccaaaggcgctgaggttcttcgcggacaagcgcaagtattccagaagacggcgcaaaaagccgagcagcatctcgaagtcgacgacactgtctttcaggaactgcgcagtactcggcgacaactggcggagcagcagcatttaccgccttatatgattttctctgataagacgttgaaggcaattggcagcgccatgccgcaaagtcttgatgagttgatggcagtcaaaggcgtcgggcaggcgaagttggataagtatggccaaatctttttggatgtcctgcaggcgattaaggccaaggcttgaatggctagtgtcgatcaaaaaaggtcgtgatcgcgtctttcccgttttgaagcggggggatgcggtcacggcctttttagctttttaccaggttttctccgccactatggtttatttggcggagaaaagacaattacggcggagaaaaatacctaagcccagtcaccattgcggaaaatcggaacgacggtgccatcggccttgatgccgtcaatattcatgtcagctgagcccatcatgaaatcaacgtgcgtgttactttggttgaggccagccgcggtgcgttggtcggtggtcatggcaacgccgtctttgacggagaatggataagcttgtccgagcgccatgtgatcagaggcgttctcgtcatataacgtgttgaagaaaatcaagccggattgggaaatcggggatggatcagggaccagcgacacttcaccaagcgagcgggcgccggggatctttagcaggttttgtaataccgcatctccacgatcagcatgggcatcaacgacttgaccgtttttaaaggtaaaatgcatcccctcaaggatattcccggagtaacttagcggtttagtggaggcaactgtaccatcaatgcggcggaaatccggcgccgtgaagacctcctcagtcggcatgttggccatgaattcctcaccgcgcggattataggcgccagcgccttcccaaatatggtgcttgggcagaccgacaaccaaatcagtacccggcgcgacataatgaagccgatcgaactgctcagcattcagccagtccgcttttgttcgcaattgttgatcatgggctttccaagcggcttcaggatcaggctggtcaattcgggtggttttgaaaatggccgcccagagtttatcagtcgcttcttccggggtcttggcatcagggaaaactttttcggcccattttggacttgcggcgccgatgatggtccagctaatcttcattgaactgattgcgtccattaggcgggcgtaagcttgattgaaggcattttgatagttggcgatgcgttgtggatccagtcctgcaaggttgtcaggatcggcagagatcacagtaatccgtttggcattgtgatcgacccagtaatcaaactgacccttaatgaaatcggggatgttgtacaggcgggatgttgccatgtgggccatgtccaaccgcttgatcagatcatcgtgccactgaacttgcacttcagcggcaccacggtcataagccgcagccacaatcaactgcgcaagtttggcctgatccacggcaatttgcaaataaaccgtgtcaccgggtttcacggcgacgccaatatcaaccgcgagctctgcatattgtttgaggcttttgtcaaagttaggtaatgtcatctttcgttccctccaaatccgtcgttggcaatagtctaccatagcagtcatcatcacgtgctcaacagttctaaaaaacgtccgtgctttatgttcaaataaatgacaccacaaagcatggcgttctctttaaaaaatacttcgaaaaaaattaagaaaaccgtcaatttgtttgcaaatagtgtttctttctggtatgaggtctggtaaaataacagcataacatctagattgccttttggagtggaggcgtatccaaaggtgtttgtaaatgagttgtgtgcaagctagttttaaataactaaagaaagcaaggggaacattatggcacgaaagaaaacaattacgcatgatcagattctcaatgcggcgtatgaccttgttgtggaacagggcttcaagagtttcacagcgcggaatatcgccaaaaagatgaactgctcaacacagccaatttatttagaattcaaaaacatggctgagctgaaacaggctgtcatggatcgaattaaagaactactttcactgaaaatggcaaagcattttaccaacgatccagtcgttgatttggggcttgcttatatcaattttgcacttgaaaatcggccattgtatcgcgccgtttttgtggaagatcacttcggtgttgatgaaatgcgcgaatatgcgatgagcaccgcaatgcgcgtattcgattcttacgaaccagcgcagcacttgaacgaagcacagttgcgcaacacgatctgcggggtatggatcgttgcaacggggatcgccaatttaatggcaccaggcttcattgatattacacgagatcaaatggttgatattctaacggctgtgacacaagacttcattgttaacggccgcttctcagacgacccgcgcatctcttggtttcaagacgccaagatcgctcagggatactaacgatcattaatagcaaattggggataaccgttccgatgtggagcggtttttttagagcgtgagctggcccgggtagaaaccggaacataagtggcctcaaggctaaatggctgggttttggccatttagccttgaggtccttatgtgtaggtttctgggccagcgaacgcgtttaaaggcgaatgctttttcaacgacaatgagtcccaccggttaaaaaagacggcaacagtgcaaaccctgaccttgggccaaacactgctgccgccttttacatagtcgccacttcaccgaatcactggaaaaccatctcacaatgcgctactttaaaactaacgatgttgtctaccgtctcacaagacaacacagaaaaccacaagggagcttattatgggaagttcatcagacctaaaagacctattacgcgaacgaatcgccgctaaatataccattgacgatttaaaagatactgggaaaaagattcgtaaaaccgcaccaattgaaagtctggctgccgtcagtaagattgatcgggaccccgtccagttcattaatagtgtcgaacaaaacttaaccaaatcactgctgcctatgcgtcatagtcgcatgggcgcttcacaggcagctttttttcgcggcactgctgagttgatggcctatgacttgcagcaaggggagaagtctggcatcaatctgttaattgatggtgacgcccacttacagaatttcggtttctacgcatcgccagaacgcaacctgctttttgacctcaacgacttcgatgaagcgcagatcaacagctttgagtttgacatcaagcgtttgctgacgagtgtttatttgttaggcgaccaacaaggatttgatgcagataaattagatgaattggtacagactgatgcatcgatttatcgtaaaaccttacgggatcttttcaaggttggtgcattggatcgtttttatcagtccaccgaagtcaaccatcttgtgcagtcgatccccggcgctgaagattcggcgttgctgtcgaaatttgtgaaaaaggcgacgaagcgtaataatgactcggtgatcaaaaaatacaccacgactatcgatggcaacatgcggtttaaagacgatccgccaagctccgtcaggttggataaaacgacttatcaggcgatctttgacggctttacccagtatcgtaagtccacgcggccggatattttggtgctactgagcgaatatcggattacggacatcattcatcacagcgtgggtatcggcagctttggcacgaattgctatctcgttttgctaagcggattaggtggcagccatcttgtgctgcaagtcaaagaagccttgccgccgcgacctgaattaattccaaatacggaacgcatcacgttacaacaagaagtcagtcagggacagcggatcatcgcatcccagatgattttgcagaaagcctctgatccattcctcggctggtttaacgtaggcgataaaagctattatgtccgccagttccgtgatatgaaggggtctgtggatcttgaggaactgactttccccgagtttcagtactacacccagatcaccacgtatctattggcaatggcacacgctcagacgcctcaggctgcagtggttaccggctatctcgataaaagttttgacagcgccgttcagcgttggagcaaatggtatctgaatcaggtaaaagcggattattcagcctttatgcgggcagttcagacgcacatgctggcctgagccatcttggaactgattgacagatcagatttttcttgtcctgatgacgctcactctggcaaaataaagttaagacgctaatcacctaacttaatgacatgcctgaagagcagggcgtcacagaaaggaggcaagtgattatggctcgcaaacaacatcaaaaaaagccgccgctgctttccgccgaacaagaagtcgcgattcaatccgggcgtgcagcattggcagatttggcgttgccacgccgcaccaaaatgcgggtgtttgttaaacttgccatcaatcggatcaccgaatcgaacatcggccaaagtgctgctgccttggcgtactataccttgctgtccttattcccattgattttgtttgtcgccaatgcattgccttattttggcttaacatacaaaggccttgctgcctatttgacacaggcaatcccatccaatgtcatgaattggttggacccagtgatcgccaatctgttggattccagcagtggcggtttgctgggaattggggcggttgcgactttgtgggcggccagtttaggcgtgaatggtttgaaaatgggcttcaatcaaatttacggcgtcgagtcatcgcaaaattttattattcaacgcttattatcgatgctcatgaccttcacactcatcattgtgatgggcgccattctgattgtttttgcatttggccgccagtttctggaatggctgatcccactgcttcgtctcaacgatgactggctgcgaacatttaataccctacgttggccagtgacgattaccgcgctttttgtcattattatgtttttaaattattttctgccgaacgtcaaaattcggatgtggacagtcttaccaggcaccgcctttacagtcgccggttggctgttaattgcccaagcgttttccttatacatgaaatattttgggacacgctatctgtcctatggcacgattggcaccttcatcgcgatcatgttatggcttaacttctccgcactggtgctgttgtggggcgccgtcatcaatgcactcaccgctgagtatttcattggccgactgcatggcagtaaaggcaaggtgcacgatttcgtcaaacgccgggtgcggacaccacacgaagaaaaagaagcgaaaagctagtcattgagcgagcaaccatggctgagagcagcaaaaaaggacttgcgttcatctgagagcgcaagtccttttgttttaaacggttttattgcaatgcctgatacttttcaacaagttgtttggtaaaggcctctaggtgcttaatatcgtcttcttcaggggcgagatcgatcttaacgtcttctgcacccttcgtggctccggtcttggcaaaagccttgtcaaagtcgtctaccgaagtggcaaagtcatcatagaagcgatcaccgctgccgcagcaaccgtagaccttacctttaagatcgagttcttgcaactcttcatagaagtcaacggcttcatcaggcaactcgccatcaccgacatctgaataggtgtaagtcgcggtgacacaaatatcgacatcttcaaaatcgctggccagcgcttgagaaacttccgttgtcgtcacgtccacccctaagtcctcaaaagcttcttcaataataccagcgatatcctcgttgttgccggtcaaactggcatatacaatccttgcgcttgccatttttctcttattcctcctaaaacacagcgctcgggggcttacacgtcggcgaggctgccttttcttgttcatttgcctgattatagcataggggacacgactctggggatgtgaatcgaaaaggccaatgatccctgatgtcatagccgacaccgacactgtttaaccaaccattctcagacttctgttgtttatccctgattaatgctacactaattgcgagctaaacttgtattggaggcagaaaagcttgatcacgatcaaatcagcacgagaaattaaaggcatggcaaagtccggtgccattttggcaggtatgcaccttggcctgcgcgatattatcaaaccaggtatctcaagctgggaaattgaaaagttcgccaaagaattctttgaatctcatggcgccaaggccgaacaagtcggttttgaaggttataagtatgtgacttgtgtcagcatcaacgatgaagttgcgcatgcggttccgcgtaagggcctgaaactcaaagatggcgatgttgtcagtgttgacacggttgtcagctggaatggctacttcagcgattcttgctggacgtacggcgttggcaaggtgtcagaagctgaccagaagctgatggacgttaccaaaaagtccctgtacttagggattgatgaagcagttgttggcaatcggatcggtgacattggcgctgctattcagacttacaccgaagatgataacggctacggcgatgtccgtgagcttattggccacggcattcagccaaccatgcacgaaagtcctaatgtgccgcattatggcgtgccaggtcatggtttacgactaaaagccggcatgaccattacgatcgagccgatgatcactgaaggtacttggaagatcaagggtaaacaagtcccaggcgatacttgggaatactacgtcactgctgacggcagcaagtgtgcccagtacgagcacacgctggtcatcacagataacggcccgaagattttgacttctcaaggcgatgccattgatgagaagtacaagttaaccgaggccgatcttaaaacacttcctgaataatagcggccaacgcgatcattcagaaacaatagggcacgaaaaaacggggtggcgacgatgattgctcaccccgttttgtatgtgagcgcgaatcagcccggttagcaaccggagtgtaagcggccttgatcgtgatggtcgggctttgaccattgcaatcaaggtccttatatgcaggcttctgcgcaagcgagcgcgttatcgtaacttacaaacgaatggtacttaatcaaaccagttcacgttatactaaaggaaaggacgaaaagagggagtatatggcagatcctgaagcgctgatctcggttatcatgccagtctacaatgcagagaagtatctcgcagaggccttggacagtttattggcacaggattatccgaattatgagattatttgtgtagacgatggttccatggataccagtaaagttatcttggcggcttatatgcgagaaaatccccgaattcacgttgtgcgggttcaaaatggcggtcaagcacgggctcggcaaattgggattgatcatgccaacggggacttgatcacgtttatggatagcgacgatcttgtgcatccgcagtggctatccaccatggcagacgggatgaaggcaccacgggtcgatatggtggtcgtcaattattacaactacattggcagtacgaagatgaaggcacgcgcgtttcgtgaatcgacatttaaaatcgaaggcgatgacaagtatcgctattggttagaggatcgtgatttgcgcggttatttgtggaataaattattccgtgccgagttattcgaacagcctgtgcctgtcgcgaattttaatttgttagaggatgcttactttatcggccatcttttgccgcgaattgatcaaatcggcttcattgacgaacctcggtattattaccggttcaatgcgaccagcagtgtgcacgccaagtttcaaaagcgtgatttagaagcaatccatcaactcggcgccgttttcctgaccctcgcgcatgacaagccggaattgacctcactggcagtgcgccgttatgcagccctgagtctatttgtgttatcaaaaatgtcaccacgtcagcttgttaaaaattggggttatgtccgccagcttgggatggtactggggcaatatacccgcgagtttcaagatgtcatctcggcaggcgatgtcaacgatttagcgacagaaaatccagacaagcccaacaaaacgagcctgacaggcaggttgcgcgcatggtcgcagttgctggacttgccgaccttcgatgacttgaataagcttgccaaggcggatgatgatccagaagatgtgaaaagagaatcctagcgagggacaaccgcactcacagccgcaacaatatttcgcgtgagtgacctcagcgttcaatgactaagacacagtcactagacgctgaggccacttacgctcttgtttctaaacgactcgcacaaaaaagccgccactcatgtgtttcgcgagcggcggcttcctagcgatcatcgaaaaggggctgatgggggtttcagcaggtggcggttgttcagttatgcctgtggttctgcaggttgtggttccttcttctcatcaacgtggtagatttcagtaacctgtgtctcggtcatcttggcgcctgtcggagtcgcatacaggttgacgccatccttgacgaaggccttggcatcagcgacaatctgcgcgaactgtttggcttgatccgccgttacgtcagcttcgtacttgtttaaacgaatactggtggtcttaccaagtgaagatttgaaactaaaagaaagtgttttcataagttagccctccgtttaggcgttcagttcggtttgctgctgcaagaccgtgctgtgcagttgagtacccgggtacaaactagcgaaggcactgccgatcgcgagtaattgaccatcgtcagcttcaagcgcgacgttgttcatgcgccggacttgtttgtaatcctccttctctgggtcgatcatcgtatagacaatggcttgtgctttgattgttcgtggcatgttacttcctccttgttttcagcgcttgcgtgcgcttttcatcgtcaattgcaactgtgtgactagacttggccgaagtcaggtcacgcggtctttaaaatacaactaggtggatcaaaaggtgccatggcatcgtaagacatttttttgccttacacttatacaaatcggtgaacccttcgatttgacaaccctaaatgatcgaaaattcggaaaccattgcacaaagttgaatctctgctaaaataattaaggtgattctttagaaatagtaaggtttttgttggtttacgtcactgtgacgtaaggtcagctatacttacagtcggattccctctggggtcctatataaatgaaaaattgaagggttctgattgtgtgataacagcgcaggcgccaggcaagctttatgttgccggtgaatacgcggtggttgaaactggcttccccgcaatcattgtggcgttagatcaattcgtcaccgtcacggttgaggcaacgaagcatttcggcagtatcgtgtccgagcagtatcaggaaaactcgctgtattggcagcgtcaaggcgacgagatggtctttgataatcgggataatccgtttcattacattctctcggcaatcaaattgactgaacaatacgctcgagagttagacaaaccgctcgcgttatataagctctatattgattcgcagctggacgccaaggatgggaagaagtatggcctaggcagttcagcagcggtgactgttgccaccattaaggcattagccaagttttacgacttgaaaatgtcgaaggatcagatctacaagctggctgccattgcccatctagacgtacagggcaatggctctttaggtgacatagcagcatctgtctatgggggatggattgcctaccgttcgtttgataaagcgtggttggcggcagcacgaaaccagatgtcactagccgacctgattaacactgactggccggacttgtcgattgagctgctcacagctccggctgacatgcaattgctggttggctggacaggttcaccagcttcaacttctcagttggtcgacaaaattacgctggccaaagcgaagaagccacaactttaccgtgacttcttaacagctagccgcgaaaccttagaaaaattaattgatgggttccgcaaccgttcgttgagcagtattcaagctggtattcgccgcaaccgtgagttgttggatgaattagctcatttctcgggggttgcgatccaaacaccagcattacgtcaacttgttgaactagctgaacaagcaggcggcgcggcaaaatcttcaggtgccggtggcggcgattgtgggatcgtcttgattgattctcatcaagccatcaaaccgttacttgcggcttggcgcgaccatcatatcgagcctctgaaatttaatgtgcatgaaattaatgattaaagacaactcgattgctaatggtgatcgagttttttattttcagcgatgaaaatgtgaattctttgttagaattcaggatttccaatacttttcgcaagcggtttctagtatagtatagtaggtagtcaaattagtaagagaagggacttgtgtacacgtgaaagttcgtaaagcagtcattccggcagccgggcttgggacccgctttctgccagcaactaaagctttagccaaagagatgttaccaatcgttgataaaccaaccattcagttcatcgttgaagaggctaaggccagcgggattgaagacattctgatcgttgagggtaaacaaaaacgttctattgaggaccatttcgattctgctcctgaattggaacaaaatttgaaagaaaaacataaagatgccttgttggagttggttcactccactactgacatcggcgttaatctcttcttcgttcgccagccatatccgcgcggccttggggatgccgttcgtttggcgaagtcattcgttggcgacgaaccatttgttgtcatgctcggcgatgacctgatgcatgacaaggtaccattgaccaagcaactgattaacgaatacgataagacccacgcatccatccttgccgttaaaaaagtgccacatgacgaagtttcagcttatggcgttattgaccctgaaaaagaagtttcaaagggactcttcaacgtcaagaaatttgttgaaaagccagctgttgccgatgcaccaagtgacttggccatcattggccgttacttgttgacaccagagatctttgatattctcgaaaatcaaaaacctggtaagggtaacgaaattcaactcaccgatgccatcgacacattgaaccaaacccagcgtgtcttcgcccatgaattcaccggcgatcgttatgacgttgggaataagtttggctatgtgaagaccaacatcgagtacggcctgacccatccagaagtgaaggatgagttgcgtgcttatcttcttgatttggcgggaaagttgcaggcaaataagcctgttgggaagccgggaagtaagaaatagtcatttatattctcgataatgagatttaataacaggttgacttaatggggcgatgattgcgctcagttacgttaacctgttttttgattttttacaggagccattcactaaaaaattgacgtttttgaaatgaaaagctacggttactgtgtataggcgtgaaaaataagaggtgggattatgaaaaaaggagttgaattcggggttgtattcttattgtcaaaatccctatttgttttacggaacccgaaaagatcgtttcaaggcactttattggaacggtgatggttttattctattttagaagcgtttagaaaatgaccgtatacggtggtcaaccgacccggcttcaaacagcgggcgattgaatcaaccatttattctagaataccaccaaaagttctctgacatcgcaaacatttggtatatttggtatacttattgaatgataggttctattaatattaaatattcttggagatgacttgtattggaagaactctttaattttagcagtcatagttcagatcctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccgttcattcgggtgataggcgtggcaaaagtaaaccggtatccgatagcgctttgtaagcgcctgatcgcaggaaaactctttaccgtgatcaaccgtcactgatcgaaccggacccggaaagtccaccatcagtcttgcaaatcccttgagaacagcattttgtgataagttttcaagcttagttgtcgccattaaacgtgtcacccgatcgacaatggtcaaaacagcagcctttgacccgcgaccaccgcgaactgtatccatctctaaatgtcctttttcggttcgccgattagctgactcactgcgaatctcaattgaggtgcctactgcttggttatagcgcgaccgaaggtcttgtcttcttttatgacgtttaccgtgatcaaagagttggcttggctgaaaatcgacttgtctttgataaatccagtggtaaatcgtgtgtggcgcacagtgaacggcataaccgaccatttcaggggaccaacctaggtttagcttctcagttaccatccgcttcaacttaggcgttaaaatcgagtgccgaccacaacgatgccgacaagtatcggcatgatcctgagctataatggcgcagtaatcaccttcagggcaacggtgaagctcatgcctaatagaaatacgagagcggcctaaggtcgcggcgatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggagatgactttgatgatccaatcgaaatgtacaaaaagggatatcgagccggtaaacgaattaatggtccgctagactatcaatcagaaattatcatgaaatacttttcaaaacacttggaccgtcgagatgttgccattgaattacctacaggttctggtaaaactctagttggtctgattattggcgaatacagacgaagaaaaaggggtgaacaagttgtctttgtttgcaccaataatatattagttgatcaggtttgtacgcaggcaattaaaaagtatggtatcagggtattgaaatttacgggtactcaaagcgagtactcaacaagtgatatgcatgtttttctaagaaatgaagcaatcgcagttacgaattatagctctgtctttaacaataattcgttcttttcagacgttgatacctttatattcgatgatattcacggcgcagacaactatattgcctctccatggacttttacaattaatcgattcttagacggagagggtagtaacgaacaggtcaacgtcgtatatgaccaaataatggatctgctgagtactactgaaagtagtccggagattaaaaaatctttagttgatgatccagaggttgaaaactcagtcaattctgtatcattatttgagttacaaaaattttggaatgcaatatcagaaattgttgagtcaaatcgcgatttgataaaagattcgaaatatgcgtggagtaatattcctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaatacatcgccgcgaccttaggccgctctcgtatttctattaggcatgagcttcaccgttgccctgaaggtgattactgcgccattatagctcaggatcatgccgatacttgtcggcatcgttgtggtcggcactcgattttaacgcctaagttgaagcggatggtaactgagaagctaaacctaggttggtcccctgaaatggtcggttatgccgttcactgtgcgccacacacgatttaccactggatttatcaaagacaagtcgattttcagccaagccaactctttgatcacggtaaacgtcataaaagaagacaagaccttcggtcgcgctataaccaagcagtgggcacctcaattgagattcgcagtgagtcagctaaccggcgaaccgaaaaaggacatttagagatggatacagttcgcggtggtcgcgggtcaaaggctgctgttttgaccattgtcgatcgggtgacacgtttaatggcaacaactaagcttgaaaacttatcacaaaatgctgttctcaagggatttgcaagactgatggtggactttccgggtccggttcgatcagtgacggttgatcacggtaaagagttttcctgcgatcaggcgcttacaaagcgctatcggataccggtttacttttgccacgcctatcacccgaatgaacggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggtattaaagaacatttaggcgcatgtaaccttttctacgataaaaaatcaataacaataaagcctctttattctccaactctcacacttgaaaacattagacaaaccaaacaaagaatttatttatcggcaacattcgggcatactgaacaaacttctaggacaataggagtatctgataaaatagactatatcaaactcgatagtaacagagaacctacaggtggaagacactacttattatttccgattattaataatcagaatgaaaatcaaattgagaagtacgcaaacttattaaccgaggtaattcctataaaaacaaaggccgttattcttactaagaataatagagatcgtgatttattcaatgctttattaccaaatagctttaaaaagtttgatatttctcatattcaggatttttacaattcagaagatggtatcattgtactgtcaaataggtacgatggcttagattttgaagaagatttatctcatttacttgtattatctgacattgctttggctacaaacctacaagaaagattcttatcctcaagaattaatgcacgaattttatacagagaacaaatacaaacaagaattattcaagcaataggacgtgcttcacgatctgaacaagattattcagttgtaattattttagggacagatttgcagaatcaattacaatcgcataataaagttagtccatttcctaaaatgatacaggccgaaattaatactgggattcaactatcaagtaatatagaaaacagtgacaatccaagcgttaatttatcaaaagtcatagagtcattgactagcagaaataagacggcaattgagaaagttgagaaacagatcaatgaagaattgtcattacttaacgacgataaaaatcaaccagattatttagaaaagcttaataggtctgcaaagtatgaattaaagtgcaattatgacctatggaataataattatgatgaagcttttgttaacgcagaaaaagctgttcatgaactgtctgacgacataaaattattaggatatcgtgcgttttggttatacctcgcagcatattcagcatacgaaatttttcagaaaacacaagatcctattgacaagaaaaaatgcattagatgtatagctgaaatgcattcggcctctcagtacacgccatggtttggcaaagtaatagttccagaatttagtgaatcaacaaatgctaatgagtcaaattttttggatgattctttgtcattattatttgaaaatattgaaacttctcttttttccggtaatttgaaaaaaacaaagttaaagtatagacctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccgttcattcgggtgataggcgtggcaaaagtaaaccggtatccgatagcgctttgtaagcgcctgatcgcaggaaaactctttaccgtgatcaaccgtcactgatcgaaccggacccggaaagtccaccatcagtcttgcaaatcccttgagaacagcattttgtgataagttttcaagcttagttgttgccattaaacgtgtcacccgatcgacaatggtcaaaacagcagcctttgacccgcgaccaccgcgaactgtatccatctctaaatgtcctttttcggttcgccggttagctgactcactgcgaatctcaattgaggtgcccactgcttggttatagcgcgaccgaaggtcttgtcttcttttatgacgtttaccgtgatcaaagagttggcttggctgaaaatcgacttgtctttgataaatccagtggtaaatcgtgtgtggcgcacagtgaacggcataaccgaccatttcaggggaccaacctaggtttagcttctcagttaccatccgcttcaacttaggcgttaaaatcgagtgccgaccacaacgatgccgacaagtatcggcatgatcctgagctataatggcgcagtaatcaccttcagggcaacggtgaagctcatgcctaatagaaatacgagagcggcctaaggtcgcggcgatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggtagaaaagatgtcactaagacgcttgaaaaattaaaagtggaacctgactcaaaatcaaatgggaaaaacggtaaaatttttgaacaaggttttcaagaattaggacgtttattaggatatagatcagaaaacacagttcaagactctgctccagacccatggtggttcattgatgatacaaaagttgttgtttcggaatgtaagatcataacggaacatatacctacaaagtatgtcagacaagccgctggccataaggagtggcttatgaaaaataatatacctggcatcggtaaagacacaagcatcattactgtatttatttcaaatcaaacaaaattaaaaagtgatgcacgaacttttgcggacaatatctattacctaaaccaagatgcattatacaagtttgctgtaagcgctactaatactatggctgaactgattacggaactatcagaacgcaatgatatttcgtggagggattatgcaaaaagaaaaatggtagaaaaaaatgtaacacctagtgatttattaaaattgatagagaaggaaaaattatctgaacttccttcctagaccacctttttaatgccgataactaaaaagtgaaagttgaatatcgacagagagtctcgagaaatcgaggcttttttgcaccaaagagacgcaaaccgcttcgcgtcgtatagtaagcactcaataacagcacggattcccaaactctaatcacagtactaaactagcctcatcaaatatggtgaggtgttttctatgtcagaaaatccagatattgttcaagttaaactcgatcaggaaagcccatcacggcagccactgccagcgtctaagaccctccaaatccgggttaacaaccgtgaaacggtcgttatttacaaccacattcagggctatattcttgatgccctcctgaaggcggtgttccctgatgctcattgatatgcgccagttacatggcatttacattgtttgcggcaaaaccgatctgcgccgtggtattgacgggttggcgaatgtggtgacacaccaatttgaacttgatccttataacaaagcactgtacttgttctgcggaacgcgcaaggatcgtttcaaggcgctttattgggacggtgacggctttatcttgctttacaaacgcattgaagatggtcgcctacaatggccactgaatcaagatgaggtccgcaaacttcacaccaagcaattcgtacggctactttcaggctgggccatcgaccgaccgtacatccaatctccatgcattaaaagctaaaaaacaatcgttattgcgtttgatcagtggtacactcatgccaataaatcaaagacaagtggcgatcagcgtgatgacagaagaagaaattaaacagccactaagtaatcaaacttaataacaggttgacttaaaggtacgttgattgtaatcaattaggtcaaactttttttgtggctgctgataaagtgattcttattctgaagagtttcaatttaggcattgcttcatcagcaaatacttcaataaaagtcattcggattaacgatttgtcagcaagagcattacataacagatcctttagcctcgatccgtcatcattgcgttgttaggttaaaaagcgaagaatagtaactcgcaagaaaatgattcggtaatcatgagccactaccggcattaagcgaaatagcgtacagttaatatataaatacccggggagcaaaggggtgagactatgagaaaaagctggagaatctttttaacggtattaacgattgtgacgagcatgaccttgtttaataacgcaaaacaagtagatgccaaagttaagttcaccaacggtttaaatatttttaaaaacgaaccggaaaatgcaagaccaagtaagctttcatccataacaaccattaacaaacatggcactatgatttatgatgatgacgctattaaacaaaaagacgtgataacagcagcagcagctcactggaatagagcagttggcatgaatttaattatgagctatcaaaaggctcaagtggcaaaggctgatgccgatgttgtcataaagtccacaaatctgcctaatggcgttgttgccgaaactggttacaatggtattgttcatgaaggttggcaaaacataattaaaattggcaatggcacacttgacgatgctagttctcaggagggttttgttcaagctgtagcaacaataagccacgagatgggtcatgcgctaggcattaatcatgattcgggtgcactgatgggaacaagtggcgcagggaaacttgcaaaagggattcttccggatattccagattacaatgttaatgccatcggggatatcttggaaaatctagatcaactatatgtgggcactagaccggtgatcattccaaatatgacagacgggatattttattgtcgtgctaatgcaacgatgaatgtttggcatgctgacctagtgagtcaactccttaccggaaaagatcgtcttttgactagagatttcatggtggtgcagtcaagattacaggtaacgagaatgtcttcaaaacgaggctcaatgaagttgggtcaactgactcaatgagactatagaaaaagcggtcccattactccttgctttgaggaatactgggaccgtttcttaatgtgggccgtcacgcaacacgttgggcatgacgattaatgagaaaaatgtgggtctacactttctggtgttgagaaataatcaacactgaacgtgtaggccctttttggataacgcaaaaagacacctactcagtgtccatgctatgcttgttagcgtcgaaaccaaaagcaagcgaggttatgagtaaatgtcccaatacgatcctacactgtccgtccttggaataccagaccataatatcaaagttgcttttgttcgtcatgaatatcgcggcaacggggtacgtcgccgccagtatcatgtgattgatgccgagctgacttaccggttaacccggtgcccactgtgtggctttgaggccttgcaccctaacgggttttatacggcccacgtgcgcgtcctcaatggggttgaaatgccgacagtcattgacttgcacaagcaacgatggcgctgttataactgttaccacacagtcagtgccaagacgccactcgtgcaacccaaccacacgatcgccactcacatgacagagcgaatcatgaagttagcgcatgaacggttgccagtcaaaaccatcgcccgtattatcggaatctcagcttcctcggttcaacggatcattgaccaaaatctcaaactccgaccggctcgccggctgcccacgcgactctgctttgatgagttccgttctactcatggcatgatgtcgtttatctgtcttgatgccgattcacatcatctgatagccttgcttggtgatcgattcaaccgcacgattaaaaacttcttcatcgctcattattcactcgctgaacgcactcgggtccagacggtcaccatggacatgaatgcagcttatcagacgattattcatgaggttttccccaaggcccaagtcgtcattgatcggttccatatcattcaacttgcggctcgtgcccttgatcaggtacgcgtccaagcgctcaaacagcttgatgacaaacacagccgtccttataagatcatgaagacaaactggcggctttttcatcaaactgcgcctgacgctaaacacaaacagttcctgtttggtttgaatgaatacgtcacgcaacaggaggccatcgatatcgcacttgatactgagcccaagctcaagcaaacctacgagacctacttagcgcttcatgatgccttgatggtgaagaaacatcccacggaactggcaaacctgttagctacttacgagccaaacggtacggcaatggacatgacgatcgcgacgcttaagcgacacaaagtcgctgttctcgccgctgtcaccagcccttattccaacggtccgatcgaaggggttaaccgcctcatcaagtcactcaaacgatcctgttttggcttcaagaatcagctgaacttctttaaacgaatctaccaaatcacggcataacatgacaaagacggctccccaaatggagaaccgcctcaaatgataaatttattcttcaacaccagttgacgtagagcctaaaaacagccgcttatcttctggcatcaagtcagagaatgagcggctgtttgcattttgttgttcgtcccggaaaatcgagaataagcaaggttgcattaaaaacagttgttattacaaaccgttttgctgaataacctgctgataccaataaaacgactgctttcgatagcgcgccaaagtaccgctaccgtcatcatgtttatcaacgaagatatacccatatcgtttcgccatttcacctgtgctggcagagacgagatcaatgggtgcccacgaggtatagccgataagatcaacgccatcttgaatcgcatctgccatggcggctatgtgggcttgcaagtagttgatacgttcggtgtcttcgacggttttactgccgtctttttcgatcagatcgtcacgtgtcccgaagccgttttcgacgaccattaatggtacatggtaacgatcatatatttgattgagtgctgtgcgcaggccacgtggatcaatttcccagccccagtcgctacgatcaagataggggtttttgacgccgctgaagaagttgccgcctgcttgctcgccttcacccgtggtggtcatggtgctggattggtagtaagagaaggtgtagaaatcaacggtgccggccgcaagaatcgtctcatcgtcagcgccgatatctagctggatgtcgtgatcacgccaatagcgcttggcaaagtaggcgtagcggccttttacctgtacgtcgccacagtagaagttattaaattctgtcgcggtttggacgagcgcaatgtcagtgggtttgctggttgatgggtacaacatgcgataagccagcatgcagccaattttcaagcttgcatcgagctcgtgggcaaacttggtcactaaggcactggcgacgaattggtggtgtagtgcttgcaggcgcagctgttcggagtcgacatctggactgatgaagcgatcagaatcgtccacatacataccgcctgccagataggcacccatgggacgagtgagcatgttaatttcgttgaaggttagccagtatttgacgtcttggtgatagcggttgatgatgactttggcaaaccggacgtaagcggcaatcatatcgcgagccgcccagccattgaaggcctttgttaagccgattggcgattcgaagtgggaaatcgtaatcaaaggttcgatgttgtagcgtttgagttccgcaatgatttgatcatagaaggccagaccagcttcatttggctcggtttccaatccggttgggaaaatacgcgtccacgcgatggagaaccgatagagcttgaagcccatttcggcaaacaaggcgatgtcttctttgaagcggtgaaaatgatcaatagcttcatgacttgggtaaaaggcatcagggactaactcacgggtcgttttacgcggcgtgttgacgttgccgcctagtagcaggtcgctggttgagagccctttgccgtcagtttggtaggcgccttcaagttgattagcggcagtagcgccgccccagagaaaattttcggggaattgttggtttgtcataatttttctccttaacgcgttcactggctcagatgcctgcacataaggtggcttctgaccacggctgttcacgctctgtcttacgcttctgaaacggcttgggtgacgcttaacaagtggtcgtcagtcgtcacagtcgctttttcttgaatggtaatccggtcaactggcgtatttagcaacaacaccataaccgttggatcgaagccttcctgttcgatcagtttcagatcaatttgaatcagcggttcgccagcggtgacgtgttggtctgccttgacgagcgttttaaagccgcgaccgttcattttaacggtattgatcccaacatgaatcaaaatttcctggccagtggccgtggtgaggccgatggcgtggccggtgggataggtcatggtcacgacagcatccactggggccacgatgaggtcgtcttccggagcaattgcaacgccatggccgagggagccggaagcaaaaacatcatcattgacatctttgaggggaatcagttttccagtaaccacacttttcaggttttggcacttgatggctggctcgttcgtgtcggcaggggtctttttctcgacaatggcaaagagataggttgagacaaaggttagaccgaacgcaatggcaacagtgaaaagcgcgttgcggaagttggcgggattattgccgataaaaactggcaaggtgaaaataccgggtgagccaaacgagtagcgcacgagaccagtgagtccggcgaaaaggccagccaagccgcctgagaccatgacacaggttaaagcccgtttgtatttcaaggtgaccccataaagcgccggttcggtgatccctgacaaggcggtcacactggcagaaagcgcgatctggcggccacgtgcctgcttttcacggaaggcgatggcggctgcagcaccggcttgggcaatattgctggcgagcatgccggggcccatgatggtttcgctgccgaatctggtgattgacagcgtcgctagcggcaacaaggaaacgtgcatcccgaccatgacgagcagcggggtgaaggcaccgacaacggttggtaccagccatggggtgtgttggttaatgaaggtgacggcagtgtagaggccatctcctagcaagctaccgatcgggccaatgacaattaaggcgacgggggccgttatcagtgcgactaataatggtttgagcatggttttgataatggtcggtgcgattttttcggcgaatcgttcgacatagctcatgaaccagacgatcagaatgatggggatgacgctgccaccgtatgaagcgaggcggattggtgcaccaaacaaggcgatgggtttgccggctgcgaccatcgcggtgaagttcgggtgtagcaggacgccggccatcatcatggctaagtaagtattggtgttgaattttttggcggcactgacggcgagcatgaatggcagaaagtaaaaggcagcgtcggccatgaagctcaaggttaagtagggaacacctttaggatcaaggccgaacaaggcgagaatcgcgatcacgactttgaacatgccgcctgcgatcaagacagtgataattggtgccatgatgctgacaatggcattcaggacccgttttaaaatgttcttttcatgatccgcgctgggtttggtgccatcaccggcttcgcggatgtgatagtttttggtaatttcggcataatatttagtcacattggcaccgatgacgacctgtgattcgtcgcctgagttcacggcactcagcacttcaggcatttgctcaagtcgctgaatatcgaactgggttttatcagccagtgtgaaccgcaatcgtgtcgcacaatgattgagcgttttgacatttttggcaccacccaccgctgccatgatacgatcggtgattttttgatggtcagacatgttgtgttcctcctcggatagtgagcgcgagccagcgcggttgctgcgctggggggcgcgttatggttggggtaaggcatgagatgactagttagttaaaacccggtggatatgaataatgagataagccaactcttccttagtcggttctttttcgtagatagcaataatggctttttgaactttaagtgcgattttggccgcttccggatacacagtgtagacacttgtgagtagttggccatcatcagcgagcatggtatcaccaaggtaacgctcagcaaagaatttcatatgggtgacaaaacgttcgtaattcaaactcgtcgtgtcaatcgtgccaccagtcagcgcacgcaccgcctgcaagacgttgtcaacaagctgggtcacttccaaaatattcgctttaccggccgcggctggtgttgcattgatgatgtggaaggcaatgttagccgcttcttcccgtgggagtgccaattgcaaggtcgcttcgacaaccgtcagcccatattcgccaatggcaaacatttcggggtagtaggttttcatttcccagtaaatccgattacccagtgattgcttgctgtgatagcgctgaactgaaaaagccagatgatctgttaaggcgtagtagatactgggaagaagggacagctgcagttgctgctcagcatacgtcacaatctgtgaggtaatgctgatgtaaacaggtggtatgttattgagcgattggatcatttcgcttttgcgactgtcatccagcggcatgaattttttgaagatcgcgttgtcgggaagacaggcgttcactttttgccgatagccaatgcccttgccaaacgcgatatactcgtggccgtcctgttcagcgaggacgacattgacattgagcacttttttgatgcgaaacatcggacacccctttcataagtcgttcgtgtgatgcttgcgggccgccacttaccgcaagttttgcaaaggacgcgtgccagttgttgcgaagcgcgtgtttggtggcacaaaaaagcaggcagactgaagaaaatcgtttgcgatgaaacgataatccaagtcttgcctgcataagcagtaacatgcgcttgtgatgcgttatctggtcaatgtattttagcatgatgactatagaaaacgcaaccatttcgatgaatgaaagcacatatttttattattttatctgataatcattaatattttgattcaggaaagattataaatatgaatgtgattatattaaagactggttcagcatgtttggggctgaatgatcgcttaagaacgctttcgaacaaaattgttaccctttgaaaaattgagcttttttgtcagtagtcggaatttaagatcccagtgccaaggcggagcaatcgtaggccagatggggctcagccgtgcaaacaacacagcgagggtctttggcgctgatgttgttaggcgactttgagatcgcggtttttgcgagctcaaagcgctgtctccgctctagctccgcgttgccagccccatctggccggagatggcggagtttggcacggcagtgaattgattagcacagtttgttattgccacattttccgaaagcgagcgggccagttaactagaatggcatgtttcccgtttcgcggccagtattcaaggaaagcgagggcaattaagccgattaacccaaggcttgtcacggtccagccagctttgatcccaggggtgtgataactcaaggtgaatttcaggtttgttgaagggactttgagtccgatgaagccgcgatagttttggattttcacttgcttgttatcaacttgccagcctttttcataggggatggttaacatgatgtagccgctgttgttttgacgggtggttaaagtgacgctgccgtttttgacgacttgtttaggcgcgtgttgttttgccgccgcaaccgcctgttcgaatggttggcgattgagggtatataaagcaaaatgatcgagatcaatctgatcaatgttgcggttgaacgttaaggtgacagttgtcggtttttccgcgtcaataggtaatgagaccgttttgctgccattgtcaggatcgtttttgagcggcacattattgatgctgatggccatgtttttgcgcatgttttcacccatgaccaagtaacgctgctcggtactcgggttgacatttaaggtaatcgtcgcgccgagctttttatcctttttggtggcaatggcattggtcaaggtggtcagcggcttcacgttgtcaacggtgatgccggagaaatcggtggttgtgaaaattgcgccgattgtttccggtgtgaaggtgctgaagtaggcattttgttgaagcacgggattagcttgtacctgtgtcggtacttttcgataaatctgggtggccacagggagcgcatcaggattttggtaaatattgaaataatcgttatgaccgatcaacttgtatgccggtaaatcataacgggggttgtcaatgattcgagaagaaatctgctggtattcaggcgttgtcgttttcgtgctttgcgtattgaccagcaacagttgccggacaccgagcaggctttcgagcggccaagtcaggtcgttatttttcacgcggccggctgagccaatggcaccgacattggttaacgcattgatcgtgctagtgttgaggacggatgagaaggtgctaatgccgttaaaattgtactgataaggatcgtccatggaacgctgggtatcactgtttacccggtaaaaagtatttggcgccagtgttttcgcttcggtgtaagctgcattaagcgccttgcttgtaacggtgaagtctgcttttgagatgaaactgatggctttgagactcgcgtatgcattggcgcccatatctagcaccagcaaggttaggagaccgccaaccacccatttttgtgggaacaggtgatgcgcccaactatacagtaagatggccgcgactaagagtaagacgccgccgaggacgaggttggtcaaggtgacatacttgtgactgcccatgcgccaagccgttgggatgaagacgcccccgccgacaaccacgctggcgatgatcattcgtagacgtgagactgacggcaggttggcgagaccgcgtaaaccgagcaataacaaccaaaaaatgacaataaaagaatgccgataaaggtaccaaaccggcgcgcgaaaaccttgccacatgatgacaagcgggttgagccaaatggacagcatcagaatcacagtcatcacgccggaaatcaaacgctcgcgaaccgagattgctggagctaagaagtaaaagacagcgcctaagagggcgatcatgcccatgtataaattgggtaggccatttgataactgcgcaaagttgaaactgccaggaatcaattttgacggcagatcgatcagcgagaaaagcggtttaatggtgaaatctgcaccagcactggaaagacgtgaggcacttaaggccaaataagtggggatcaagacgatggcgccgatcataccgctcagtaacgacccgccgacgaaaagcgcgattttgcgcagcagttgaggctgatggtgactcgcccattgccagcagaaatacagcgccgagaaaatggcgaccatgaaaccaatataatagttcgtgatgaagcttaggcttaatggcacaacataggggatgagccggtgttcttcaaagaggcggtcaatgcctaaaatcacgagcggcaataaaatcacgccgtccatccacatgatattcagaaagttggcaatcaggaagccggaaaggccgtaactgacgctgaagaccaaggtgtaccagtttttgccatagcgatggctggccaatacctgcgcagcaagtgccgcggtgctgtacttaagcgcggtcacaaacagcatggccacgggaatggcttggcgcgatacaagcacgaagatcaagttgaaaggacttaacaggtaataggtccaatttgcatacatgccgccgccaagactgttggagaaagaataagctttgccagctgtgcccattaaggcgtgtttcagataagtaaagaaatcaacatattgaacggctgaatcgtttgccaaaatagatgacgagccaaaaggcgccatttttaacgcggcgaaaacgatcagactgatggtgaaggtcatgctgaaactgatgagcaataatggccatgttcgatgctttttaaatcgcgacatatagagagggactccttcgaaaattcggtagggtcaaaagttaataaacaatatgatagcagaaaaaatgactgacttaaaaataagcaagtcttgaatattaacttaatcataacgcgtctttgaactgaaaagtgaccggaagcgcaatgaaagcgctgtggctgctattttaaaaaaacgtagcaattggtgatacttgtgacatcaggtcgtgtggtcaaagggatgaaaataatcttttccggtaagacaaacagcatcggggaacggtacaatagaatgaaagttattttgggaggacggtttatgcacgcacagacatcatcagcaaagctgaagacattcatgacacaaaatgctgtctggctgttgccgattttggcgatggtcttggttttgctcgtacagtggccgcagctgcatctaccctatatctttcatcaagacgatacgatgccacagctgcggcggttggaaagctatgtgaccagtgtgcggcacggccagtattttcccaaggtttttcctgaggcagtccgcaactttggctatgcttttgacgcgtactatccttcattaatgttgttgccatatgtgtggctacggctgatggggatgggggtggtcggtgcgtatgatggttatcaggccctcattctcatcgtcacagtattggctgcctacgctagtttcttgaaaattcggcgaaaaccgctggcggcgtttgttttcagcatggtgtatacgactgcggtctaccgggccttagacgcctttgtgcgggggccttgggtgaaaatctggccttcattttcctgccgatcatcgccgcgggcatgtatgagctttacgtcaaacgaaccgataactggtttttactggcgtttggtgtgaccggtctgatgtatgcgcatatgttgtcgctggttatggtgctggaatttttggttggcggctttctcgtgttggttggcatgcggcgcgtgacttggcgaatggtcaagtacacgatactggcagcgatcagtacgctgctgatgggactgggcagctacttgccgatgattgagatgtccagtcatattgcgttgaagttaagcgagtctgcgacgatctggccgaacttcatcctctatagtttgggtgatctttttgagaactccctgagtatgtatgcctcaaccagtaatatgcagaatgtcggccaagcctttcgacctggcatgggcattttcatgttaatgacagccattgtgctggtgattcgttggcggaaattgaatcaagcggttaaggtagttactggcttagggctgttgacgatctttctaagcaccaatttgttcccgtggtcgttgtttagcaaaacgatcttcggtgtcatccaatttccttggcgatacttggagctgacgactttatttcttagtctggcaattgggttgatcgtggcggatcgtccagcctcatcacatgttgcttgggagctggtgctggcaacctgcatcgtcggtttcagttatgccgtgaatatcaatgcgacgatgcttaatgccaacatttatcgcatcaccgatgagaatgcaccggcttattatgaagatgcaactggcggcgggagtgagtatgcaccagaagattttgattcaacgactttttttaaaaagacaacttattcggtaacggcttctcatcaattgacccggctaacgatgccgacccaaacttacaatgatatgcgttttacctataccagcagcaagccggtgaccctgaagctgccaaaatttggctacgtcggttatcatgtgaccatcagcggtaagacagttgactactggccaagtgggaaaaatgctcagattacgatagcggcaccagcaggcacgcatcgtgttcgagttgtctatacaggtacggcgctgcaacatgtgaccggctggctttccttagtggctgcgcttggctttggcggctggtggttgttgcgtgaaacacgcaggcaacgggcaacggatgagcggataacgactgggtctgaataatgaaacaaaagagattcttgccgtgccaaactccgcaatctccggccagatggggctggcgacgcggagctagagcggtgacggcgcttcgagcccgcaaaacccgcggtctcgaagtcgcctaacaacatcagcgacaaagcccggtcactgtgttgtttgcacggctgagccccatctgacctgcgattgctccgccttggcactggtatctttaaattctaataaaaatatccgtgaaaaaaagcaaacaattttccgcaataaggagttgtttgcttttctttaatagcactggattatgtcccagctcaatcatttttaaattacttttgactatgtgacatacagttacttgatctcacgtgcgataaaaatcgggcgtcgtttggtttctaagtaaatgcggccgatgtagcggccaacgatgccgagggcgaacaactggaggccgccgatcatcagaaagatagagaccattgacggccagccagcggtcggatcaccgtaaatagctgcgcgaacaacaataaagattaaagcaaaaaacgagccaacgaaactcacgataccaagaatggacacgaaggttaacggtgcttcagagaagtcgatgatgccatcaagcgcgtatcgcaagagccccatgaaggaccagctcgtctccccatgttgacgctcgatgttgcgataaggcagatactttgttttgaacccaacccaactgaatagccctttagagaagcggttgcgctcggtcatttgaatgacagcttcgacaacctgtctcgtcatcaagcggaaatcccgtgcccctggcacaatttgagtttgcgagactttattaatgaatttatagaataaatccgagaaaaatgaacgcatccgagcttcgcctgagcggtcagtgcgttgagcaccagccatatcatagccgtcttgcaaggcggcatacatatcaggaagcatcgctggcgggtcttgcagatcagcatccataacggcgtagtagtctgcttttgcggtagagagaccagcatacatggccgcctccttaccaaacgagcgagaaagatcaatgaagtgaacctgatcgtcttttgcttgtaactgtttgatttgctgaagggtatcgtcacttgaaccgtcgttgacaaaccaaatttgggcttgtaacgcggttaagtcgtcgcggaatgttttaacaagttcttgatagatcagcgggacattttctgactcgttatgacatggaatgataattgccacactttgcggcatgagaaggcctcctgttttgcgttaatttgatgatggctggagaaataatttgacgtgtcaactcgtacggtaccgttataataaaactaatcccgcatagacttaatggcttttgctagtttatctgtttgactggtgacggttgtgagattggccgtcatgacatcgatttgttgattgagtgaactgtaatattgattcagttgagaaatttggctttctaagtcatcttgtgaggtgtcactatctgcggtggtggagaagaaggtatcctcagccgttaacatttcgcggtaataactgaccagtgttttgtgatctaacttggcgagtttcagacttgtgagaacgttattcaactgtgtttgtggtgtatcctcagatggctgattgttgagctttgtcaacgtattatttgccccaaccaaagcgctgttggcggcttctaatgatttaaacgccgcggcacgcctatccaaaagttttttgacagggccattttctttttttaaatcagtttgcggatttccctggtaagccttttcaaaagcagaaggaaaggcgtttaccgttgatccaatcgtctttaacgcatcttgttcttgctgcacctgcgtttgaacggtggcggttgtggtttttaactggcttttaggatttaaagtcgccgagcatccaacaatcaagactgccagactggctaacaaaatgagtaattttttcatagcagctcctctgtttatatggtagcgtaaagcccgattaaatactagcggggcgtgacgagtacatgtgttgactattcattaagtggaatgttctatgctaaactgactctggagggtgatggccatgcacataggtatgcgaacggttaaaacagcagtggggacggcagcggcaatgctgattgcttacgagttgcaccttgaatattggacggccgctgggattattacgattttatcagtccagaatacgaccaaggcatcatttcggctagtcgcatatcgcttattggcgaccgtgttaggttttgtgattgcgatcggtgcatttttggtgctggggtacaatgcactggctttcggacttttcttactcatttttattcctttgaccaacgtgtttgcggtgcagagcggtatcgtcatgaccgcggtgctagtcactcattttatgatggcgaaaagctgcagttggttctggattaaaaatgaactattattgctcgcagtgggcgctggtgtggcattgattgccaatttgttcatgccaagtctggaagccaaaatcactgagtttcaggcacaagtcgaagccgagatgcgcgagattctcgatcatatgagccagcaattgggtccggatcacattaaaagtgcggacaattgggcgaatttgtcagatttgaaaatgaccttagatgccgctgttgcttgggctaatcgccatagtgacaatcaattgctggccgataatgattattttcaagcctattttgaaatgcgcgacaatcaatatgagttgctccggcaaatgcaagacagccttgaccgtatcgaaacacctgtggaacaagcagccgttattagcgatgccttggcgatgacggccagtgttctgaccgaagacaaccccgccacacaattggtcaccatggtcaaaaaaattcaacgcgattttgctaaatcagcgctgccaacagaccgcgcaagcttcgaaagccgcgcgcgattgttctatttcctagaagacttttcccgcttgttgcagttaaagcggaattttaacaatattatttcatcacagaattgatttgcggtttcctacatgtcctaagtcatttaagttggaaaataaaaaggggcgtttaatctgatggatgtcaaagtcataaaactcggtacctcattagcactatcgctgccaagtggttcgagtttcaagcagggggatgcttttctgttagttcctgacaagagcggaagttactcattagtgccaaaaattaaccacccatatgctgaggctaaatctctttcactttatcaacccgaagagtgggctgatattgagcacaattttcgctgatgtcccatcgccgcaagcaaggtaacgatattccagttgattctgtctctcaaagtgacgaaaattcaataatggcattctctgatcatttgagcaatcatgagtacaatagagtagttgcgtcatcggcattctaagatagaaagcaagagctggcggagcggcgagggggctcagccgtgaaattgttgttggcggtttaccgcctacaacaaggccagactttgaaatcgcgcggggtttgcgcgagttcaaagctgtgcccacagctctagcttcgcggtcgccagccctcctcgccgcgtagccagctcggactaggggagatacttgactggaatagaactgaagagaaacgtcgtttgcattgcaaaaacgcgttcgcaggtttctaatcgcgcctgctcacgctcttaaacgcgatcgccaacccagaaatctgcgtgtaaggaccttggatgcaatgaccaaagcccagtcatcacatccaaggccgcttacactccgatttctaaccgggttggctcacgctctatacttgcttgccgtttggcgtgatggtagactaaatatgtactttttgaatggtcgtggttgcatggtttcagaactttcttccacttgtaccaaacagaaatacacgatattatcatgcgtcagcagacgcaaggaggaatgttctcatggaacacggcacagttaaatggttcaatgctgaaaagggttacggttttatcactcgcgaagatggtagcgatgttttcgttcacttctcagctatccaaggcgacggctacaagaccctcgaagaaggccaagcagtcacttttgaagttgaagacagcgatcgcggtccacaagcggttaacgttaacaaagactaatatgaaagtttcagagctggttgcagagatgcaaccggctttttattttcgcgtgtgcacgaggacagatacaggtaaaatgggtgagtagcgatgttgcgtgccagcttcaaataaaagtggcggattgtctgactttttctaaaactcatttggcaggtgctcaatgcgtgtaagtgcatgttaaactagttcatagcatgttaattgaaacattttttggaaggtggggaagggctgcatgttaagatttgtgaaagttgcgccggaagctcggttgcattatttggatcttttattgattggggatgaggatccgaatatgttgcggcggtatttggacgctggcacgttatttgcagcgattgacgagactgtgccggttggcgtggccatggtagtgcctgtggatgctaccactattgaactgaagaatcttgcggtactgcctgcccgccgtcgccaaggtatcggtgcgagcttgttacggtacgtcggactggtgtatgcgcctgattatcaggatatgctggttggtactggtgatgtggatttcgagaatctgcgtttttacatgcgccagggattccggtttgacgcaatccgtaagcatttcttcgatcagtatgcccatccgctgtatgcagaagggatgcagttgcaggacatggttgtgttacgacgacggttgttattgacaggttctgataaaacaaaggagtaatgcttttggccaaaaggcgccgacattttacgttaaaaataattccgcttgctgcttggctagtcatcggtttctttgcgatcggtgtgacgcttgtggttggttcatactgggcccaacaacaaacagaagtgacgcaaaaacaagaagttgcggatgaaaaggcggcagtacgcgcaaaaaaagttgcctttattaagcgcttggtgccgacagcacaggtcatgcaaaagcaatatggtgttttgacaagcgtcaccttagcacaggccattttggaatccaactggggtaccagtgcattggcgaaggactaccataacctgtttggcatcaaaggtaccgatccagccacgaccaaagttttgcgcacgcaggaatatgtcaatgacaaatggatcatggtcgatggccgttttcgggtgtatgacaacgacagtgagtcgatccgcgatcatgcgctgttattcgttaatgggactgattggaatccgcaacaatatgccacagttcgtgccgctaaggactataaaacagcggcagctgctttgaagacggatggctatgctactgatcctgattatccacaaaaattgattcatttgattgaaacttggaatctaacccaatatgatagctgaacgttcgtgttttagtgatgcggcaatcctcgttattttgactttttaaagccgaatcacggggattttacttattcttttgatgaaagcggcttcgcgtgtttgttcgggaattagcgtgattgtgttgttccacactgatttttatggtaagcttgttgaaaatttacaattaaaaggagtgcttgtggtgaaattactggaagaccggatcaaaaaggatggccaagtaataggaacagatgtcttgaaggtggataactttttgaatcatcaggtcgatcctgatttaatggcagatctcggtcatgaattctaccggcgcttcagcaatgagccgatcaccaaaattctgacggttgaaagttccggtattgcgccggcgattgcaacggcaatggagtttcacaagccgttggtttttgctcgtaagcataagagcttgactttaaaagatcatctttacacagctacggtctattcgttcactaaaaaaacctccaatgagatcgctatctctcgcaagttcctttcagccgatgacaatgttttgatcattgatgattttcttgccaacggtcaggcggtcgaaggtttgatggatatcattgcacaggctggtgcgacactgagcggtgtggggattgtgatcgagaagactttccaaaaaggccgcaagttgcttgatgaaaagcacgttcgcgtcgaatcattggcgcgcatcaatgcatttgaaaatggtcaggtcatctttgcgccggaggattagcccacgatgaagaataaagcgatttcgaatcctaaagcagccgcattgggactgcagcatttgctggcgatgtattccggttcggtgttagtaccaattctgattggtgcttcgttgcattttacgtctgagcagatgacgtatctggtgtcgattgatatcttcatgtgtggtatcgcaacggctttgcaagtatttggcaacaagtattttgggattaagctgccagtcgttttgggctgtgccgtccaagcggtggcgcctttgatcatgattggccagaagtttaattttcaaacgatgtacggggccatcattgttgctgggttgttcgttttcctaatcggcggtgctttttcaaagttgcgtttcttgttcccgccgttggtgaccggttcgttgatcacggtcattggcttgtcgttgattccggttgcttttcaaaatcttggcggtggctcaacaacggccaaggattttggtaacatgaccaatctgatggtcggggccttcacggtacttctgatcttagcgatcaatgtctggggcaaaggtttcctgcattcaatcgcgattttggttggcttgattgctggtacggtgcttggcggttttcttgggttggttagttttcagccggtgattgaggccagctggttccacgtaccgacgccattttactttggggtaccgcagtttgagtggagctcgattgtcacgatgattttaatttcgatgacatccatggtcgaaagtactggcgttttcttcgcgttaggggacattgtcggccgtaaaattgaagcagacgacctgaagcgcggctatcgcgccgaagggttagccgtgatgcttggcgggttgttcaataccttcccatacaccactttctcgcaaaacgttgggttggttcaattgtcagggattaagacccgcaagccagttattttttccgcgattttcttagtgattcttggtttactgccaaaaattggcgctttagccacgattattccagcaccggtgcttggcggggccatgctggtgatgttcggcatggtggctgtgcaaggcattcggatgttgcaacaggttgattttgacaatgataagaatttgcttgtcgctgccatttcgatcggtctgggacttggcgtgacagttcagccacatatcgttcagttcttgccaaaaacaattcaattgctgtttgggtcaggcattttaatgaccagcttgagtgcggttttgctgaattggctgttcaattcgccacgtcggacgcaagaaatgtcggttgatgaaggcttgaacgaacgcgattcagataaataaagtcaaagcgaggaacagatgtgacgcaatttattagtccaggtgcaacgattggcattatcggcggcggtgtgactgcttttcaaatggcgaatgcggccaattcgatgggcatgcgcacggtcgttttggcgccgacacaaacggatattgcttttgaaaaggcggatattccgttggtgggcgatgccactgatcggacagcgctgaaagaactcacgcaattaagcacagtgatgacttttacagatgagaatgtcgatggttcgttgctggcggaattagccactgccaaccaattgccttccggggtcgacattttgactgtcacccaagaccgctatttggaaaaagtctttttggacgatctgaatatgaacattttgccttatacccaagtcattacgccgaatgatattaaagaggctgttgacacaatcggttatccagccttgctgaaaccgattcagaaggggatgggcgttgaccagcagttgctgctgtccacggcagatgacgtcgcgcgggcacagcagttgttgcaacagcgaccatatattcttgaggcatacttacaagacatcaaagaagtcgctgtgatcgttgcgaaggcgggatcagaagtgcgcatcggcccggtcatccagaattattttgatcgtcatcaactgaaggcttcatctgtgcgcgccgatgttgatccagcagtgattgttgagatccggcgtatcgctgctaaaatttcagagaagttagcctatacgggcatctttagtcttgaatttttcttagccagcaatgggacgctttatgtgaagcgagtttatccagggccgaaattatatggccatctgatgctgaatacgagtgacatttctgaatatgagctgcatctgcgcgcaattctaggctggccattgccggagttgcaattggctgaggacggcgttggcattccgctgcgttcagaagatatggacgcggttttgactcagattcaaattaaacctgattggcgatttacgttttatccgactggtggcgagctaaccggcgagattcagatcgtgggtgatttgaaagcaatcaaagccagtgtgaatgcgactggccactttgtcattcaatgatcgcgtgctggcagtcgaaaaccaaggatacctgttgttgttttgtccacttgaaggaggaaaaagcctgtgattccgcgttatagtcgtcccgaaatggccgcaatctggtcagagaagaaccgttatgctgcatggctggaagttgaaatcttagctgccgaagcctggtccaaactaggggaaattcccgctgctgatgtccaagcattgcgtgcgcatgctaagtttgatgttgatcggattcatgaaattgaagcggtcacgcatcatgacgtggtggcattcacgcgggatgtttctgaaagcctcggcgctgagaagaaatgggttcattttggcttaaccagtaccgatgttgtcgacacggcacagggctacctgttgaagcaggctaacgagattctgcgtgcagatttggccgccttgaaggctagtttagcgaagttggcgaaggcccataaggataccgtgatgatggggcggacgcatggcgtgcacgctgaaccaactacttttgggttggttgttgccacgtggtattctgaattgaagcgagacatccgtcgatttgaagacgcggctagcgatgttgaagctggtaagattagcggtgcagtcggtaccttcgccaatacgccgcctgctgttgaggcgtacgtcacagagcagttgggtattcgcgctcaagaaatctcgactcagattctgccgcgtgatctgcatgcgcattacattcagacacttggcctgattgcgacttcggtggaacgatttgctttgcagattcggcatatgcagcgtaccgaagttcatgaagtcgaagagcatttcaacaaaggtcaaaagggctcgagtgctatgccacacaagcgcaatccaatcggttcggaaaatgtttctggcttggcgcgcgtcattcgtggatacgagacgccagccttagaagatgtgctgttgtggcatgaacgcgatatctcgcattccagtgccgaacggatcatgttgccagatgctaccgggctgcttgattacattctccatcgcttcaccagtattttggacaatttggatgttttcccagaccgaatgaaagccaatatgaatctgacgcatggcctgatttacagccagcgggtgatgctgaagctgatcgaagctggcttgagccgagaacaagcctatgacttggttcaacccaagactgcggtggcatgggatgagcatcgcgccttccgtccgttgcttgaagctgatccgaagattactgatcggttaagtcaggccgatttagacgatgctttcgactaccactatcacctcaagcatgttgatgagattttcaaacgagttggtttagcataagcaaataaatcaaacaaaaacggcgagtgcagactcgtcgtttttgtttggccgcattttgcgccacctgttgaccatagaaaaagtcctgttcaagttgtgatagcaacgagaacaagactcattttgtcagggcactcagcgtcaatacaggcggttcctgccaagcatggttaggattcgcatttaacaaggattgatctgttgttaaaactagcaagcaactattggtttgttgcaatgcatgattggcttcagtgaggaagtcgcgggtaacataaggatcaaagatcgcaggagagctggttagcagcaggtaacgttttttacccatcaagccacgataaaattgcaaataaatgcgttgcatggtgttcaatgtcgcagctggctggtctaagatcggtgaattcgtggataaccattcaggcaagaaatcagaatccttgcagcgtccattgatgcaaaggttgtttcgcacgctgagatagtcaaggatacctgtatgccggctattaatgaagccgacttgcttgatgacgccaccattaataaaatcgcgcacgtactgatcatgcaaggcaatcaggtcattctcgtttgaggcatagagatactgaatcgtcgttggggtaaaaagtttggcaaaattttcgcgatagatatcaagtagttttgatcgaaataacatggctgtctcctaacgcggtaaggcacgccttttccgaagcatggaaagtggtgtgaccaaacctatgttggtgatgaaaatcacggcgagaccatttcccagtgctgacaggaaaccggttggctgtgtcatatcatcagttttgctaccgtaataaaagagggtttcacgggtaaaaccagtcaggtgacgggcaaagagttgctcaaatgcgtggttcattgcgatgctgtcatacttttgttgtagcagatgggcaaataccgaacgatttgtggtcgttaagaaataaatcaattgatcatttaataaaaccacaagaaaaatactaacaatgaagctaattaaaaagctgaaaattgcttcaaaggcgtattgtaagccgatcgacatactgctttttccgactaaatacaaagcatcagtttcagaccgtcgacgccgccatagccaagcagttcctgcaagccacaaaagaccgtcagcaaaaacaactttggtcagcatcgactgagcagcctgcaccatttgaatgtgggcttgtccgacctgcgtactgagcaaaatcgtctgcctattttgtgttccaaatgagttcaagcgttgcaaaaaagctgcctgagcagattggtcaatcatttcacttgtcatcagcatgatgctgatcaagcagaacgccactgataacagcatcatcacaatataataacggcgatgataacgaaatcctgaaaacgttcgctcaaagaaatgcatctacccgttcacctcacaagcagtataagcaatgaatttgaacaaagtgtgaacataagccgagcatttactatgttatttgaatttatttagatggttgagttgtgacattcacatcagacgaactgctagatttgctgctgctggaggcttcagtttgatcctgaactttatctgggaaggtggtgatgggatcagtgtcgtcggctaattcaggagcatcagtttggtaaagtccagttgttgattggtcattattttcgctatagagactggtgctcttgctgcctagattgcgttcgattgacaagacattgctgagactctgattgtagtcatattggttagggttgacgggtttaaagccaagtggcacgtagaagcgtaagagattgcggttagcgacatcgtctgaaaggctgagtcttgtgtccactgacttctgatccttggcgatggttgcttcaagcgcaggcgtcaatgtcagcagtttaccggttgtattatcgtagactttactgccaagtacggtgtatttagaggtgacaaaattgtgattacggaaggcaacgacgctgtcgtgctgactggacagcagatcggtgccaaattggacataacgcgagctatcaatgcctagtaagtgaagtaaggtcggcaagacgtcgatctcgccgccgtaagtgctattaacgccgcctttaagaccaggcatgtggaaaatcagcgggacgcgttgcaactgagcatcatcgaacgcattccaagtgctaggatccttgccaagcaacggtgccagagtggtattgcgatcattactaataccgaaatgatccccataaagcatcactagcgaattcttttccaaaccgcttgctttcaaatagttgaagaattccttgagcgcttcatcaagataatgagccgtgcgaaaataaccgttgatcgtggcgtcatcagtaccggcgtcaggaaaatcggaatcagcttgggtgatataaaaaggattatgattgctcgtcgtgatgattttggcatagaaaggctgttgcagatgctccagatactttggtgtctcggccatcatcaacttatctttaatgccatattcagtcgctgctttttcgtcatgattataaaagttgccggaaaagtagtcgttataaccaagactcttgtatacattgtcgcggttccagaagctagcagagccaccatgaaaaacagcactggtataaccggctcgttgattgagaatggccggcgctccttcaaacgtattttcagtgccgagactgctgaataaagagccattggcaatcccaaacgtgctggtttctagcatgttttcggcgtcactggttttaccaagaccaacttgatgaaagaagttgctaaagctaagtgtgtctttttctttaatgagtgaattcaggaaaggcgtgacttcttgaccgtcaattttttggccaatcaagaattgttggaagctttccaaatgaataataatgacatttttgcctttggccgtcccaaaataactggcgtttggagcggcataatgtgaccgcgtatattgcaatactgggtcaagattcgaactgtctgcttgggcgcggacctgattgttctgggctgttttggcagcatcgtaaacggtgaatggcgccaagccgagatacttaacgatataattccgatcaaaagtccgcgtcaaaagttgcggccgattcatttcactaaccgccatgatcaacccaaacagcgcgatcccaaagacggtgaccgcttgcggaaagtgaaagggaagttggcgggtatccaacgtcagaccgaaatgcggccagcgcaaaggttcattgtggatatagcgccagatattccaaatactgtaactaaaataagccaaggccactagcacaatatcaattacataaatgatatcgtgtggtttaaccatgctaagcgagctagctccaagaccctgactcactttagagacgccaaggaccgtgttgatggtcagaaaatctgaaaactcacgataatacagaacatttgcgagcaatagcaaagtgctgagtatgtaaacaatgacgccgatgaggtaaccgcggcgcgcatgcttgggatacaagccaagcgataggaaaatgatcccagttcctaaaggatttaataatagcaaggtgtattgtagcggatcatttaagccaagtgaaaagtccacaaagtaaccaaagatggtcttagcccataccaaaaaaagcagacaggctaaaaagccaatccgggttgatcttatccactgtgcgaggcgatttagtcgtaaccgtttcaaagcggcaactcctttccactttgttctttgtcattgtacccgcaaaagggaggaagcacaaaagcagcgtctgagccaacttggttttgggggtggcaagcgtgtctcaatatctgaaaaatgagctgtgcttgcgagcgtgtttctgaagcaactgcaaaaggcctaattaccattttgcttagacccttatgtgttggtttctacgctgctttgggacaatgaggcgagaacgctattttagtgctttttgatgtcccgcgccggcctcccgacatattggtgaaatgatcttaaatcttgatcccgtcgctggtatcatggcaaatcatgcaatgattagcgtacctcattttcctaatggcagagggtgatgctcatcattcttacagagtctttaaaagttgtaacacattgtgggtatccttcagtcactttgctacaatgacaactggaggtagcacaatgctgtttttggggccattttacaactggattaatacaacctcgctcagtcgcgtcaaccattttcctttggttcgattgattgtttttagtttggacaaaactattctatacctattgatctttgcagccttgcgctgcctttggctgttgttgacgaagcggagaaccacttttgggcgggaattgaaactaggcatttttgtcggttatttaatgctcttatttgctttgacagtttttcgcgatgtgtattatccgtggcaactgcactttcattggaatcggccattatctgtgattaatatccgaccgcttgttgaaacgcttaaattacaacatgctgccagtcacttcgatctctggtatcaatcactagggaatattgcttggtttatgccgcttggctttggtattccctgggtgagcaaacgtcgacggcgtctcgcgggcacggttatatttggcttgctgacgtcgttaagtattgaaaccctacaatttctgctaatcagtggggtagcggacattgatgatgttattttcaatgtgatcggtgcgattttcggctatagcctatatcgcttgtttcatcatcgtaaataagcatgagtcgttttagtattcatcatgagttttctgtgtatcatgaaggtgagctgtctcttggaaatgctttagatcaggttgtgcttgtcttgccgtgggaaaaccgctagaatatttttttgtgttcaatttttttaaatcaatcattgaaatagaaagaggcgcgtaatgggatttttacttgcgctgattccagcaattgcatggggctccattggcttggtcagtggcaaactaggtggcaatgcttatcagcaaactttggggatgacgtttggcgcgctggttttcgggatcggcacgttgattgtcatgcgtccggtcttagatactaaaatttggttacttgggattgtctctgggcttttctgggcattaggacaaggccaacagtttcagtccatgaaatatatgggtgtctcaatgacgatgcctatttcgacagggatgcagcttgttgcgacaacactggccggtgcgctgttgttccacgaatggcgtaatggtcgtgatgtgaccttgggcattcttgcactggtattgctgattgtgggtgcaacgttgacatcaaggcgcgaacaaacagacgacttcacaacacaaagtggcgttgcaaaggggctgcgaaccttattgatatcgacagttgggtatgcaggctacacgattatcgtcaacgctgggcatcttggcgctttggccgttgtgatgccgcaatccatcggcatgattattggtgcgttattaatgggcattggccatcagccatttgctaaggcaactgccaaaaatattttgacaggcctgctttggggaacagggaatgtgttcatgttgttatcgatggccaatgttggtttagcggtttcttattcattgtcacagatgggaattgtcatttcgactttcggctcgatttatctgcttggcgagcataaaacacgcaaggaaatgatctgggttagctgcgggtcggcactggtgattctcggtggtgtcgtccttggcatcatgaaagcaaagtaatcgatgagaagttgctcgattgcttgcttttttacaaattcaattttaaagttaacttgttagagtgtgaatttgaacaaagcatgggtaactgaatttaaaagtttacttgatgagttatttcgaattaataattgaattgacgttttttatgaaaccactctcatatcgacttttgacagttacttatgtatttagaggaggaagcacacgatgtcgtacatcaaatttgattcatctaagctggacaagttcgttcatgccaatgaacttgaacagatgcagccgttagtgactgcagctgacaaggaattgcgtgaaggaacaggtgctggtaaggatttccgcggctttatcgatttgccagtcaactatgacaaggacgaatttgcccggatcaaggcagcagccaagaaagttcaaggcaattctcaagtctttgttgcgattgggattggcggttcttatttaggcgcacggatggcggttgattttctttcccagactttccgtaaccttgaccctgatctgaagttcccagaagtttattttgctggtaactcaatctctggtacttatctggcggacttgcttgacattattggcgaccgtgacttctcgatcaacgtgatcagtaagtctggtaccacgactgaaccttcaattgcattccgtgttctgaaggcaaagttgatcgaaaagtatggcaaagatggcgcaaaggaacggatttatgcgacaactgatcgtgccaagggtgctttgaagcaagaagcagacgcagaaggctacgaagaattcgttgttcctgatgatgtcggcggtcggttctctgtgatgtccgctgttggtctgttgccaatcgctgttgcaggcggtgacattgacgaaatgatgcgtggtctcggtgatggtcgtaaggcatacgcttcagctgatttgaaggaaaacgaagcttatcagtacgccgcattgcggaacattttgtatcgcaagggctataccactgaattgctggaaaactacgaaccaacgttgcaataccttggtgaatggtggaagcaattgatgggtgaatctgaaggtaaggaccagaaggggatctatccttcaagtgccaacttcagtactgacctgcacagtcttggccaatacattcaggaaggtctgcgcaacctgatggaaaccgttgtctgggttgaagaaccaaaccgcgacctaaccattcctgaagatgctaacaaccttgacggccttggctacttggctggcaagaagatgtccttcgttaaccgcaaggcctatgaaggggttgttctcgcccacaccgatggcggcgtgccagttatgaccgtctccattccaaagcaggatgcctacaccttaggctatctgatctatttcttcgaagctgccgtttcaatctccggctacctgaacgggatcaacccattcaaccagccaggtgttgaagcctacaagaagaacatgttcgcattgctcggccgtccgggttatgaggatatgaccaaggaattgaacgcgcgcctttaatgacaaggacttgcgcgatttgaaatgtggtaaataaagagctccagaatcatgttggaaaagtccgtggtgaagttttggtgaaggcttcggacttatccacaggttctggagcttttttgtgttcactgatttaagtatttttcgaattgttgatggttttctttcttttttgctggggagatttcagcataaatttgagtggttgaaatgtctttatgcccaagatcatctttgatgtcatcaaggcttaatcctgcctcacgcattaaaacggcatgcgtgtgtcttaaatcatggatacggatgtgagggagcccagcccgattggtgatgcgattaaaagcaccggtagttgctcgagatcggagcggttgtccaaacttggcatcagacgaataggtgaagacaaaatcgttattgtggctagtagaaaaccgaaaaccttgtacattgccgtgactgaaatggcgctcatattgttgttgaagaagatcatttactcgagcggtcatatattcggttctcttagagcttaatgttttgggacgatcaagcgctattttgccggcgtttgatccagtttcagcacgatagattcgtgttgcattgactgataaggtatttttactgaagtcaatgtctgaccagcgaagagccatggcttcacccacacgaagcccgcagtcaatcagcgtcacaaagaatgatagccacatgggctctttatcttcttcagctgcttctataaaagatccaacttgatcttttgtccaaaagtgaagttttttggaattgtctttagcatacgcactgaactcgacaccaacggtagggtttttggtaatgtaaccaattgcaacggctttttttaatgcattgtgcaacgttccattgatgagctttactgtgttaagagacaagccatcattgaatagactgctgatgaactcctgatgttccttaagcgtgtatttggctagtcgaatatccccaatttttgggatgatgtatttcttaagattatatcgatagataatcatggatccctctttgacattaaccttaagcttagtgatccactgattgagataatcagccattaaaattctttcagtttggtagtgagagtggcctctgattatttcggcctcagctaaagttgcttcttgctgggctattttttcggttggaaaaccgcgccgatggatctttatttcttttcctgtctgcggatcaacaccggcgaatatatagaattcccaggcctttttgccatcttttagtttatatgacctaattgatgccatgatatcgcactccttttgaactcttagagcttgtaattcaaacgtatgttcgctatgcccttaaaataaaaccccgttatggggtcgtattattgcatctttctaaccatcatcatgagcacgccgataatgataaaaacagctgcccaccacaggttgcttccgggtttgtcagggtcaatgagccaacgaacccaatgatgcctgtggccaaacagggcgaagtagacgcctataagaacaatgatgaggccaatgaagtgtgcctcgcttaatgtatctggaccgttcataagtgcatctccaagaactgagcttagatttcgttaagcttactgaactcgatgtcattgttgtatctaatcttgacggttagtggtgtgcaacgaatgatgacgggtcgatcatactgtagcgatttttgaaaagtgttgaggttttcagcaaagtttggcaagacctcctcagcagtcaatacagctgtttttgcacgtaatagcaacgatgagtggtgtagctcattgaaacagtaaacagccaccacaggcttctctaggacgttgtgaatggtagtagtatcgcgatcagtgtaaaaaaggatctctttaagcgatcggtgtgatttaagtggtgtgagcgaaactatattagggaaaccggtatcggtatcaagcgtagctacctgcataacggtacactctcttaacagtatatcggcctgcctgatcgttgaatttgccataagtaagactcctgtcttaactattaatttgatacgagtagctatgcttttaagcgttgatggtgaatccaattcatctttgctataagtagatgaatattgttcattagcgactagaagggcagtgactaaaatggaaaatcgtgttgagataaaagaaggacatgtttttgtaaatggaaccgaaattaacctggtcaatgatatacagcttcatcctgcgctgaacgacacaacgcaagttcaactgagttttaaagctacgagcctggatgtagtttatcccggatctcggcggtgatgacgttctgaatgaatagtacgaaattctttatgatataatcagtgaaagataactagacattcacatagaggagcgatgatgatgaatgaagacaagctaggttatagttattcatatgatttgaaagatggaattgtcaaggtgaaggattttgtgaaatatttagagtctttacccagtgattccacaatcagaattcagggtatttcagatgatcgtccagctgttattgatgacaatgtctattttgaaaaaagtagtgggcaattggttatccaacctgattcattatctatatgatcaccaaaaaactctgtggtggatatccatgattattttgaagcttcgattgaattctacgtctagttctttatccttatgtaccacttgtatagctgacagagtgtaaagttttcctacaagaactgcgagctcatgctcttttttgttgctaataattgcctcatagttatccgtggcaatcgcatcctgataatttgagatgggacagtacccatcgtcgtcaatccagctaatttggaaaaacttgacgacttggtaaacattcttaattacttcttcgcaaagaccctttgttgggattaaagtcccgtgaataactctgttgcgtttttctgtggaatcgtacattttgttcaacataggaattgctgattctccaaatagtagtagggaaatcgttgcaaacgaagcaatagatctttctgaatacttgatagcgtgtgatttatcaatgattttgtccattggtttgtggttgtttgttgaccaaaagtaagctttgatagctgtgtttctgaatttttccaagctcgtaactgcgcttagatagcactcatagtattcttcatcatcatacgctcgtaaagcattttcaaatatcggaacatacagaggggtgcgtaatactgcatgaaatgtatgacccctaggacatataaatttcagtgattcgtcatcagttacttccgcgacagcactagatttataatcgcggcattcggcacacattgtttcaattttcgtgtcagacatctccttacattgtactgaccgtgtttacttggtttgcttatcagccctcgccaccggggctatttttgtacccgctgtccgaaaggtgagaggggttaattctgcggatagactttgatgtcaccgttcagcttataacgtgcaagaatattgccgtttgctgagttcaaagtgacaggaaccggtgtcggaatatcgcacattctggcgattccttgtgtgcctgagaatagatcagacgctagcttctgaagcttgaactggtcatatctggtgacgcttgccgtagcagtataggtaacaccattagttttgctatctacattgaccttactcagttcgctagactggttttcaacccttttttggacggactgtttgaatgctgaaagggattctgaaacattgtctgttttagacgacacactcgctttcgattctgttgagttagaattagaactagtattttctgattcagaagttgattcatcgtcggagtcattagtttcaacggggtcatcttcaatagcactttcctcagctctgctttcggatgcctcttctgctctatcaatgtccttctgataggcagctgatagaaagaaggacattactagtaccagtattcctatgcagagtgatattagccacttcattttacgggacttctttatagtagttgctatcaatccgacagtggagataagtgtgaccacaagcccaatgaaaacaacaaacccaataaaaacgttcacctttagttcctcctcaaattcacttgttggacagcttcttggccaacaaaagccccaagcaggggcatgtaaaaggactacttcatattggactgagttttcccgcttaaagcatcatttgtaaatgtcacgttgaagttggaacctagatcaccttttacaccagatgtataaccggccacaacattcttttgaccaccgatcaggctttcgttgtaatagtcaggttgcccccattttgaggtgaagtcagtgtacttcgttccgtcttggaatgcattgaaatctgccaaagtgatcttttgcttgcggtttagcttgaaccctgtaagatttttgctgaacgcgtttccatcggtaaaggagacaatcacgttagctcccaaggcgccctcaacattagtccaagtgacaagatcagttttaactccgtttgtggtactgcttgaggtagaagaggggttaccaaacttggcttttaaatcatctaatttggcaccaccattgccgttttgcatcaaatcacccagagtgatgctgtcaaagtctgcacgagtaatcttgccgctgtccttttttgatgtacttgaagatgatttatccgttttgctaactgccgttttttccgtggattcgctgcttgatttccccttattattgaggccgccgccaatcgctgctaccacaataataactaatacccaaaaccaaacgcgcttgtaaaaaggcttctttaccttatactgcttgccgtcagcacccattaccttttttgccattttgttttcctccataaataattttcagcttttaacgtcttccgtgtctggactaacaattacttcagcttgtatccgactgatttatcttgatcaatatgagctgttagaaaaatggtggctttggatatgcgctcggataccaaatctttatcagaaattggataaaccttattgtgcacggaatacttaaatccatcttttaagattgcaatttcgtctttgaagcgtttctctttgtgatacatgacagctaatttgttggctgaaagctgccccattttcttgacaatggatagccattcgttctcggctttgacccagtcgccttctttataataaagatcgcctaaatgataatggggaaggacttcatcgatgattgccatttcataatcaagctttttatttccagatggtttgtattttgagattgagatggtttgtttatacatttcccgtgctcgttgtatagaggtttcttttgccatcgggaagcctgtattaggattttttctgactgtctgtggggattttttaattttagtgttagggcgcacttctctgctagttttttgaattgctagattcttgatgggtttattggtttctaagcttttagcatgtcttattaggttgtcaaaaaagcccattttgatgctccttctgcgaaatttcttgaaaattaagcttcgttaattaaagaaatacaaaacggtcaaaagactctggcaagttgaaatattgaagtatcccataagttgttgtgatttcaatgtcttgagccttcagaatgtccaccatgtatctaacagcaaattgatttgcctctcgttcaattcttggtatccaaccgccaatcatcatagaacgcataaatggcgtgctatcgttttatgcatacggcaatggccaacttcgtggagaagaacaagcagttcctgagaatcggtaagattgtcactcaagaatatcgttgcgcagcgattagtcctgactgatagccccatggttgaattgggcatggtgacccgttttaccccatagtcatatgttttacatatggaaaatggatcagtcgaatctattgcgacatcagccgtacgtttaaaagtttggtcagcaacgtcactggcatacgacatttaatcaccgcccgtatctcgatacttcttaggtgtgaatttcttttttgctttttctttattgatacgaagccccatttctatgatgtccctcatagattgcttttgatcatctgtcatcggttcaccgtaaaaattgacactagcatctgaattcataccgtcaataatctgctgagccagtttagcgatatctttggtgtccttatcggttagctcataatatctgcgtttatttgtacgatacataagaaaatccaaagaaacattaaatatatccgccaggtcgttcaaagcatctgtgtttggacgccgtttgtcagtttcccacatagcaagagtggactgactcacgttaattttgtctgcgagttgttgttggttccagcctcgctcttttcgtagcattgcaattctttcgccaatattcatgagcagccctcctaatgtgattatacaatcacgagaagtgatttttacggtttatttcaaaaagtgattttttctgttgactatcacgtgaagcgatgatatggttatcacatcaagtgataaggaggcgaaacaatgaacaagcttttagaggcacgaaaggctaagagagagtctcaagcacaggcagccaatgctattggcatcgcacaatctatgcttgccatgatggaaactggtgatcggaatggctctgacaaaactaaacgtagagttgctgagcattacggaaaatctgttggtgaacttttttttagcgatactatcacatcaggagataaacacattcccgccagcgagaggaggcggcacgatgagtcctctaataagaagctcttggctgatgacagccatcggggatttagcaaagcaaagtttgaaatcatcaaggcaggaaagaacgggtcagtgattccagaagtgatccgggctcgctacaaaggattgaccgttgatctggctgtccagaatgtctcgtatcaatcaagcgatttaagcctgtcagaaacagatgctctggtggcacttggtaacaccgttttggaagttctaagacttcttggccttgatgaaatgccgtacccaatcggttcgattcgaaagacgttcacattggtgttcggtagagccttctcaatcagtggaagagctgcaaccactgcgtcaaaagtgaactggttttgcatcaacagcatattttgtcctgctgcaggatcgaaccggtcaagcacgctagcgacaacagggttctgattattgttcatgatagtcaactcctttaaagcgattatctcacttgaaggagaagacaagtattcaaatttcaaacagcgataggaggcagtcaaatgaatatcctcaaaaagcatgacatcttaaataaaaaacggcagtttctcactaaggaactcgggcaagagaagctcgagaaagtgattgctgccgtggaaaagctgatagaaaccgagaacattacgttaacacagctaacggacgttattcagtatcttcatacggatagtggatttcttcttccacaacagaaagcctgaattccggctcgtcacgttcattcaggtatttctaaaatggtagttaatatcactcacataaccggcagcggtatagacatcttcaatcatgtcagaagccatttccttctggcaaaacgggcaacggattgcctgtggttttacatttagatttagaggaaaagatttaccacattgtgagcaagttaagctagcgcgcgtaaacattgccaatttattcacctcccttcgatgcaattatctcactcggcgggaggcaatcacacattattcagttttcaagttaaggaggttaatccaaaatgccatcacaggtaaccgttatgaaaaagctacaagaaaccaatcctatcaaagcaatgattgtgcaactgattaaaatatctgaaagaactggtgatgggacgatttaaaatccagtcagatatgtggattattactacaccatggatggcgaaaaggtggctactgcttatgacgttcgaccggaggatgtttgatcatttgattcatcttaacaatggtgatgaaaatgtctagataggattttatttcttccagtgcttgacttgggttgaaatcatcggagcgattccaatgtacaaagtcgttggctgttagtctaaccacgtctgctggaaccattccaaatggattttctccgaaatattggttgatagcttgaccgagattcatttttgcaatcttagaagtcgaatcttcagttatatcgagcgcgcaatccttcagaagaacctctaatgcggcccgatatcccatacctgcaagatcaaggtctccgctaagctcagatcgttcagcagaattataaagagatatgaacctaggagagagctgtttgagcaagtcgtcaaattttgtacctttttgttctgggtagagcatttgctggcgcaatatttcaccgtcttttgaggctataactgcaatcgattcttttgcgcagtatgtacagtgatagcgcagcacaaacgtattaatgttcccttctaaaaagtgatctttgacagcgatagttggattaaaagatacgtggcaccaaggacacagagatggaatctcaaaagaaaattttgtgccagagagtatgtcacttaccaccttcaggggctttatatattcattcatttctccacctcgttgtaaggtgggaagtcgaaaaagtcacggacggatattccgaggccagaacacagcgcaggcagaagctcaattgggaaacgggtgacattttcttctgtcattaaatcgattattggcaaagggtcaacacttgccaaagtacagaaagagctaatgctttgtcctctttgctcaataagcgtgacaaatctgtacaagataagtcttgaagttggatcaatcggatcaagcttgaagtttttctccatggctaatactgattcactcttttccatttaaaagaatcctcctcactcgttcacgttcctcaggtgtcaaggcattacctagttcttcccacttagaacgctgcttagcggcagatgagccgtcagggcgctgattgtacggaggaaagtcgaggaactcggtgagggacatgccaaggccagacgcgacttttgctagggtgtttatgccaggattggctgaccgtgtgctgataattgcgctcagagaagactgagaaattccagcgattagcgccagtcggttggctgtcagattcttattttccaatagttgttcaatatgacgactcagaaggctttcagggctatccatgatctcactcctaacgatatatgactaagaagattgtacccagttaacgaaatattttggaaaattagcacgatatgcttgcatattagtaatatcgtgctaatatatagctatagattagcaacatattactaaccggaaggaggcaattatgaaagcaagcgaactggttcgcctataccgaaagcgctcgcacatgtcccagactgagctgtcgaatctcagtggtgttgctcaaacaactattagcgcaattgagcgtggtgttgacccaacttgggacaacatgaagaagttggcgttggcgctgaacattacagtagatgatttgatggggacggaggtgaagaactaatggaagcaacaaaggaagaacttaaggctgcattcaaagatctcctttctgataatgactttcgccgtgagatacgttccgaaatttctccagtcggcggtcttaatccagaagcgaagtccttcaaggcagaagtcaaagacaagttgcaaaaaagatatgaacagcgcttcgggaaggaagcatatggcagctacaaactggtagaagctttcaatacattgcttaggtatcattttgatcttcggaacgtttcatcgttatctgacgatcaggtgccacaagcacgtgaattgttcgatgaatacacaaagctacttgatttaaggaggccccaaaatgaatgaactaatcaagaccatcacacgtgatgatggaactatcgcagtaagcggtcgcgagctgcacgattttttgggagttggcaaagacttctccaactggttcaaagatatggcctcgtatgggtttgaagaaggtaaagacttttcgccgttttcggcgaaaaccccaaatggcgggcgtccacgcattgaatatgtcatgacgctagacatggcaaaggaagttgccatgatccaacggacgaataaaggtaagcaagcccgccagtatttcatctctgtggagaagcggtacaagcaactcgcagcactgcctcggactcccgaggaaaagcttgctttaaccatggaagtggccaataggagcgccgagaaggtcatgaagcttgacaaccgtgtcactgatttagaaaagaacgccccaattgctccgggagaatacagctacatcagccgacaggtgcggaacgtggttgagagttatatcaatacgcatcatcttcggataacccagaagcaacgtggactactctacaaagatgtcagtcgcggtatgaacgagtacgtcggtatcaagacacgaacccaactccgcaagcgagattttgacagggcagacgagttcgtcagtaactggcatccgtcaactgccacgatgatgctgattagggaaacacaagacgatcaacaaaaagtctctgatcaacttgctatgggttaatcatagccttctctagcatgaatcaatatccaccaatatttcatcttttaaaggaagtggaacgtatgaaagcaacaattagtagccctttgaataggttcgctactagaaccaacacgccacagaaggtgatcgcttatgcagcaaaattagggcgctcaacgatcaacaactattttcatggaactcccattagagcaaatgaggctactgacattgccaattcgatgaatgacagcgaactaagctatgaaatggctaacttgtttctgggaatacctaagctgtttagcggtgacggaatataccacgatttacgcgggcttttattcacc
